United States Patent 8,071,561 (IMMUNOGEN PLATFORM) - sequence listing, part 2

SEQ ID NO: 937 - protein, 9 aa, Hepatitis C Virus
LIFCHSKKK

SEQ ID NO: 938 - protein, 9 aa, Hepatitis C Virus
HSKKKCDEL

SEQ ID NO: 939 - protein, 9 aa, Hepatitis C Virus
ELAAKLVAL

SEQ ID NO: 940 - protein, 9 aa, Hepatitis C Virus
ELAAKLVGL

SEQ ID NO: 941 - protein, 10 aa, Hepatitis C Virus
KLVALGINAV

SEQ ID NO: 942 - protein, 10 aa, Hepatitis C Virus
KLSGLGINAV

SEQ ID NO: 943 - protein, 10 aa, Hepatitis C Virus
KLVSLGVNAV

SEQ ID NO: 944 - protein, 10 aa, Hepatitis C Virus
KLSGLGLNAV

SEQ ID NO: 945 - protein, 10 aa, Hepatitis C Virus
KLVALGVNAV

SEQ ID NO: 946 - protein, 9 aa, Hepatitis C Virus
ATDALMTCY

SEQ ID NO: 947 - protein, 9 aa, Hepatitis C Virus
ATDALMTGY

SEQ ID NO: 948 - protein, 9 aa, Hepatitis C Virus
GFTGDFDSV

SEQ ID NO: 949 - protein, 9 aa, Hepatitis C Virus
TPAETTVRL

SEQ ID NO: 950 - protein, 9 aa, Hepatitis C Virus
YLVAYQATV

SEQ ID NO: 951 - protein, 9 aa, Hepatitis C Virus
DPRRRSRNL

SEQ ID NO: 952 - protein, 8 aa, Hepatitis C Virus
LIRLKPTL

SEQ ID NO: 953 - protein, 8 aa, Hepatitis C Virus
TLTHPVTK

SEQ ID NO: 954 - protein, 8 aa, Hepatitis C Virus
TLTHPITK

SEQ ID NO: 955 - protein, 9 aa, Hepatitis C Virus
SLMAFTAAV

SEQ ID NO: 956 - protein, 10 aa, Hepatitis C Virus
LLFNILGGWV

SEQ ID NO: 957 - protein, 9 aa, Hepatitis C Virus
ILDSFDPLV

SEQ ID NO: 958 - protein, 9 aa, Hepatitis C Virus
VLVGGVLAA

SEQ ID NO: 959 - protein, 10 aa, Hepatitis C Virus
VLAALAAYCL

SEQ ID NO: 960 - protein, 8 aa, Hepatitis C Virus
IPDREVLY

SEQ ID NO: 961 - protein, 11 aa, Hepatitis C Virus
EVIAPAVQTNW

SEQ ID NO: 962 - protein, 10 aa, Hepatitis C Virus
VIAPAVQTNW

SEQ ID NO: 963 - protein, 9 aa, Hepatitis C Virus
ETFWAKHMW

SEQ ID NO: 964 - protein, 10 aa, Hepatitis C Virus
GVAGALVAFK

SEQ ID NO: 965 - protein, 9 aa, Hepatitis C Virus
VAGALVAFK

SEQ ID NO: 966 - protein, 10 aa, Hepatitis C Virus
AFWAKHMWNF

SEQ ID NO: 967 - protein, 9 aa, Hepatitis C Virus
FWAKHMWNF

SEQ ID NO: 968 - protein, 9 aa, Hepatitis C Virus
HMWNFISGI

SEQ ID NO: 969 - protein, 9 aa, Hepatitis C Virus
SLMAFTAAV

SEQ ID NO: 970 - protein, 9 aa, Hepatitis C Virus
LTTSQTLLF

SEQ ID NO: 971 - protein, 10 aa, Hepatitis C Virus
LLFNILGGWV

SEQ ID NO: 972 - protein, 10 aa, Hepatitis C Virus
VFFNILGGWV

SEQ ID NO: 973 - protein, 9 aa, Hepatitis C Virus
ILAGYGAGV

SEQ ID NO: 974 - protein, 10 aa, Hepatitis C Virus
GVAGALVAFK

SEQ ID NO: 975 - protein, 9 aa, Hepatitis C Virus
VAGALVAFK

SEQ ID NO: 976 - protein, 9 aa, Hepatitis C Virus
WMNRLIAFA

SEQ ID NO: 977 - protein, 8 aa, Hepatitis C Virus
AARVTAIL

SEQ ID NO: 978 - protein, 11 aa, Hepatitis C Virus
SECCTPCSGSW

SEQ ID NO: 979 - protein, 11 aa, Hepatitis C Virus
SECTTPCSGSW

SEQ ID NO: 980 - protein, 9 aa, Hepatitis C Virus
VLSDFKTWL

SEQ ID NO: 981 - protein, 9 aa, Hepatitis C Virus
VLDSFKTWL

SEQ ID NO: 982 - protein, 10 aa, Hepatitis C Virus
DFKTWLQSKL

SEQ ID NO: 983 - protein, 9 aa, Hepatitis C Virus
LPKLPGVPF

SEQ ID NO: 984 - protein, 10 aa, Hepatitis C Virus
LLREEVSFRV

SEQ ID NO: 985 - protein, 9 aa, Hepatitis C Virus
HEYPVGSQL

SEQ ID NO: 986 - protein, 11 aa, Hepatitis C Virus
PCEPEPDVAVL

SEQ ID NO: 987 - protein, 9 aa, Hepatitis C Virus
EPEPDVAVL

SEQ ID NO: 988 - protein, 12 aa, Hepatitis C Virus
SVASSSASQLSA

SEQ ID NO: 989 - protein, 9 aa, Hepatitis C Virus
NHDSPDAEL

SEQ ID NO: 990 - protein, 11 aa, Hepatitis C Virus
SPDAELIEANL

SEQ ID NO: 991 - protein, 9 aa, Hepatitis C Virus
ELIEANLLW

SEQ ID NO: 992 - protein, 9 aa, Hepatitis C Virus
ILDSFDPLV

SEQ ID NO: 993 - protein, 10 aa, Hepatitis C Virus
REISVPAEIL

SEQ ID NO: 994 - protein, 9 aa, Hepatitis C Virus
KFPPALPIW

SEQ ID NO: 995 - protein, 11 aa, Hepatitis C Virus
VYSTTSRSASL

SEQ ID NO: 996 - protein, 9 aa, Hepatitis C Virus
SLTPPHSAK

SEQ ID NO: 997 - protein, 10 aa, Hepatitis C Virus
QPEKGGRKPA

SEQ ID NO: 998 - protein, 10 aa, Hepatitis C Virus
RLIVFPDLGV

SEQ ID NO: 999 - protein, 9 aa, Hepatitis C Virus
RVCEKMALY

SEQ ID NO: 1000 - protein, 9 aa, Hepatitis C Virus
ALYDVVTKL

SEQ ID NO: 1001 - protein, 9 aa, Hepatitis C Virus
KSKKTPMGF

SEQ ID NO: 1002 - protein, 9 aa, Hepatitis C Virus
GLQDCTMLV

SEQ ID NO: 1003 - protein, 9 aa, Hepatitis C Virus
HDGAGKRVY

SEQ ID NO: 1004 - protein, 11 aa, Hepatitis C Virus
HDGAGKRVYYL

SEQ ID NO: 1005 - protein, 10 aa, Hepatitis C Virus
TARKTPVNSW

SEQ ID NO: 1006 - protein, 10 aa, Hepatitis C Virus
TARHTPVNSW

SEQ ID NO: 1007 - protein, 9 aa, Hepatitis C Virus
RMILMTHFF

SEQ ID NO: 1008 - protein, 9 aa, Hepatitis C Virus
CYSIEPLDL

SEQ ID NO: 1009 - protein, 10 aa, Hepatitis C Virus
SPGEINRVAA

SEQ ID NO: 1010 - protein, 10 aa, Hepatitis C Virus
LGVPPLRAWR

SEQ ID NO: 1011 - protein, 9 aa, Hepatitis C Virus
VGIYLLPNR

SEQ ID NO: 1012 - protein, 633 aa, Artificial Sequence
  Chimeric polypeptide sequence
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPMGLKFRQLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1013 - DNA, 1902 bp, Artificial Sequence
  Chimeric nucleic acid sequence
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgcccatgggcctgaagttccgccagctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgctga

SEQ ID NO: 1014 - protein, 9 aa, Hepatitis B Virus
MGLKFRQLR

SEQ ID NO: 1015 - DNA, 24 bp, Hepatitis B Virus
atgggcctgaagttccgccagctg

SEQ ID NO: 1016 - protein, 20 aa, Clostridium tetani
DKILGCDWYFVPTDEGWTND

SEQ ID NO: 1017 - protein, 40 aa, Rabies Virus
KFPIYTIPDKLGPWSPIDIHHLSCPNNLVVEDEGCTNLSG

SEQ ID NO: 1018 - protein, 20 aa, Plasmodium  Falciparum (malaria)
MSKVQKDSAKPLDKFGNIYD

SEQ ID NO: 1019 - protein, 452 aa, Equine Herpes Virus -1
MPAVLLVLYVNPPPSVCILTQKLSLGLYNQWWRVCRSVPPPWYVFFNKRSMSTFKLMMDGRLVFAMAIAILSVVLSCGTCEKAKRAVRGRQDRPKEFPPPRYNYTILTRYNATALASPFINDQVKNVDLRIVTATRPCEMIALIAKTNIDSILKELAAAQKTYSARLTWFKIMPTCATPIHDVSYMKCNPKLSFAMCDERSDILWQASLITMAAETDDELGLVLAAPAHSASGLYRRVIEIDGRRIYTDFSVTIPSERCPIAFEQNFGNPDRCKTPEQYSRGEVFTRRFLGEFNFPQGEHMTWLKFWFVYDGGNLPVQFYEAQAFARPVPPDNHPGFDSVESEITQNKTDPKPGQADPKPNQPFKWPSIKHLAPRLDEVDEVIEPVTKPPKTSKSNSTFVGISVGLGIAGLVLVGVILYVCLRRKKELKKSAQNGLTRLRSTFKDVKYTQLP

SEQ ID NO: 1020 - protein, 607 aa, Canine Distemper Virus
MLSYQDKVGAFYKDNARANSSKLSLVTEEQGGRRPPYLLFVLLILLVGILALLAIAGVRFRQVSTSNVEFGRLLKDDLEKSEAVHHQVMDVLTPLFKIIGDEIGLRLPQKLNEIKQFILQKTNFFNPNREFDFRDLHWCINPPSKIKVNFTNYCDAIGVRKSIASAANPILLSALSGGRGDIFPPYRCSGATTSVGRVFPLSVSLSMSLISKTSEIISMLTAISKGVYGKTYLLVPEYIEREFDTQKIRVFEIGFIKRWLNDMPLLQTTNYMVLPENSKAKVCTIAVGELTLASLCVDESTVLLYHDSNGSQDSILVVTLGIFGATPMNQVEEVIPVAHPSVERIHITNHRGFIKDSVATWMVPALVSEQQEGQKNCLESACQRKSYPMCNQTSWEPFGGVQLPSYGRLTLPLDASIDLQLNISFTYGPVILNGDGMDYYENPLLDSGWLTIPPKNGTILGLINKASRGDQFTVTPHVLTFAPRESSGNCYLPIQTSQIMDKDVLTESNLVVLPTQNFRYVVATYDISRENHAIVYYVYDPIRTISYTYPFRLTTKGRPDFLRIECFVWDDDLWCHQFYRFESDITNSTTSVEDLVRIRFSCNRSKP

SEQ ID NO: 1021 - protein, 662 aa, Canine Distemper Virus
MHNKIPKRSNTRTHTQQDLPPQPSTKSAETKTSQARHSITSARRSTHHDPLTSDRPIHYIMNRIRSCKQTSYRSDNIPAHGDHEGIIHHTPGSVPQGSGSQIKRRQSNAINSGSQCTWLVLWCIGVASLFLCSKAQIHWNNLSTIGIIGTDSVHYKIMARPSHQYLVIKLMPNVSLIENCTKAKLGEYEKLLNSVLEPINQALTLMTKNVKPLQSLGSGRRQRRFAGVVLAGAALGVATAAQITAGIALHQSNLNAQAIQSLRTSLEQSNKAIEEIREATQETVIAVQGVQDYVNNELVPAMQHMSCELVGQRLGLKLLRYYTELLSIFGPSLRDPISAEISIQALSYALGGEIHKILEKLGYSGSDMIAILESRGIKTKITHVDLPGKLIILSISYPTLSEVKGVIVHRLEAVSYNIGSQEWYTTVPRYVATNGYLISNFDESPCVFVSESAICSQNSLYPMSPLLQQCIRGDTSSCARTLVSGTMGNKFILSKGNIVANCASILCKCYSTGTIINQSPDKLLTFIASDTCPLVEIDGVTIQVGGRQYPDMVYESKVALGPAISLERLDVGTNLGNALKKLDDAKVLIDSSNQILETVRRSSFNFGSLLSVPILICTALALLLLIYCCKRRYQQTLKQNAKVDPAFKPDLTGTSKSYVRSL

SEQ ID NO: 1022 - protein, 160 aa, Betula verrucosa
MGVFNYETETTSVIPAARLFKAFILDGDNLFPKVAPQAISSVENIEGNGGPGTIKKISFPEGFPFKYVKDRVDEVDHTNFKYNYSVIEGGPIGDTLEKISNEIKIVATPDGGSILKISNKYHTKGDHEVKAEQVKASKEMGETLLRAVESYLLAHSDAYN

SEQ ID NO: 1023 - protein, 15 aa, Artificial Sequence
  Ara h I (major peanut allergen)
NLREGEPDLSNNFGK

SEQ ID NO: 1024 - protein, 14 aa, Artificial Sequence
  Cat allergen Fel d I; 15-28
FAVANGNELLLDLS

SEQ ID NO: 1025 - protein, 14 aa, Artificial Sequence
  Cat allergen Fel d I; 117-130
VAQYKALPVVLENA

SEQ ID NO: 1026 - protein, 14 aa, Artificial Sequence
  Cat allergen Fel d I; 138-151
DAKMTEEDKENALS

SEQ ID NO: 1027 - protein, 19 aa, Artificial Sequence
  Cat allergen Fel d I
MTTISSSKDCMGEVQNTVE

SEQ ID NO: 1028 - protein, 19 aa, Artificial Sequence
  Cat allergen Fel d I
DLSLTKVNATEPERTAMKK

SEQ ID NO: 1029 - protein, 13 aa, Hepatitis C virus
QLINTNGSWHINS

SEQ ID NO: 1030 - protein, 24 aa, Swine Influenza virus
MSLLTEVEPTTRNGWECRYSDSND

SEQ ID NO: 1031 - protein, 24 aa, Human Influenza virus
MSLLTEVEPTIRNEWGCRCNDSSD

SEQ ID NO: 1032 - protein, 24 aa, Avian Influenza virus
MSLLTEVETPTRNEWECRCIDSSD

SEQ ID NO: 1033 - protein, 24 aa, Avian Chicken Influenza virus
MSLLTEVETHTRNGWECKCSDSSD

SEQ ID NO: 1034 - protein, 24 aa, Avian Ostrich Influenza virus
MSLLTEVETPTRNGWECKCSDSSD

SEQ ID NO: 1035 - DNA, 3930 bp, Artificial Sequence
  EVH-1 Glycoprotein D
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgcctgcagtacttcttgtgttgtacgtaaatcctcctccatcagtctgtatacttacgcagaaactttcacttggattgtataatcagtggtggcgggtttgtagatctgtgccccctccctggtacgtgttctttagcgcggacctggaggtcgtgacatcaacctgggttctcgtagggggcgtgcttaacaagagaagcatgtctacgtttaaactgatgatggatgggagactggtgttcgccatggccatagcgatcctgtccgtggtattgtcctgtggaacttgcgaaaaagctaagcgagctgttcgagggagatcagctgacctggaggtagtcacctccacatgggttctggtgggcggcgtccttcaagacagaccaaaagagtttccccctccccgctacaactacactatcctcaccaggtataacgctaccgcactggccagtccctttataaacgaccaggtgaaaaacgtggaccttaggatagtgaccgcaacaaggccatccgcagacttggaagtcgtcacaagtacctgggtcttggtgggaggcgtgctgtgcgagatgatcgcactcatcgctaagaccaacatcgactcaattctgaaagaactcgcagctgcccagaaaacatacagcgctagacttacttggtttaagatcatgccaacttgcgcaacacctatccacgacgtgtcatactctgcagacctcgaggttgttacaagtacttgggtgctggttggcggcgttttgatgaagtgcaatccaaagctcagctttgcaatgtgtgacgagagaagtgacattctctggcaagccagcctgatcaccatggcggccgaaactgacgatgagcttgggctcgtgctcgccgcccccgcacatagcgcagacctggaggtggtcaccagcacctgggtgctggtcggcggcgtgctcagcgctagtggactgtatcggcgcgtgatcgagatagatggacgccggatctatacagatttcagtgtcacaatccccagcgaaagatgtcccattgcattcgaacagaacttcgggaacccagatagatgcaagagcgccgatcttgaagtggtcacgtcaacctgggtgttggtaggcggtgtgctgaccccagaacaatacagccggggcgaggtcttcacccgccgctttcttggggagttcaattttcctcagggagaacacatgacatggttgaaattttggttcgtgtatgatggaggcaacctgccagtaagcgccgacctggaggttgtgacgagcacatgggtgctcgtcgggggcgttctgcagttctacgaggcccaggcttttgctaggcccgtaccacccgacaaccaccccgggttcgatagtgttgagagcgagatcacccagaataaaaccgatccaaaaccagggcaagcagacccaaagccaaattctgccgacttggaggtcgttactagcacttgggtactcgttgggggagttctgcagccattcaaatggcccagtatcaagcaccttgctccccgactggatgaggtggacgaagttattgagccagtcactaaaccccctaaaacttctaagagtaattccacttttgtcgggatcagtgtcgggctgggctctgctgatttggaagtggtcacaagcacttgggtgcttgtcggaggggtgctcatcgccgggctggtcctcgtgggcgtgatcctgtacgtgtgcctccgccggaaaaaggagctgaagaaaagtgcccagaatggacttacccgacttcgctctaccttcaaggatgtgaaatatacccaacttcct

SEQ ID NO: 1036 - DNA, 4503 bp, Artificial Sequence
  CDV-H Canine Distemper Virus
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgttgagctaccaggacaaggtcggagcattttacaaggacaatgcccgagccaacagttccaaactgtctttggtgaccgaggagcaaggcggacgacgacctccttacctgctcttcgtcctgctgatactgttggtcggaatttctgcagacctggaggtcgtcacaagtacatgggttctcgtcgggggtgttctccttgccctgcttgcaatcgcaggcgtacgcttccgacaggttagtacctctaatgttgaatttggtcgacttcttaaagatgacctggaaaagtctgaggccgtgcaccaccaggtgatggatgtactgaccccactgtttaagatcatcagtgccgatctggaagtcgtcacttccacttgggtgcttgtcggaggcgtgctcggagatgagatcggcttgaggctcccgcagaaactgaatgagatcaagcaattcattttgcaaaaaaccaacttttttaacccaaatcgggaattcgactttcgggacctgcattggtgtattaaccccccgagcaaaattaaggtgaacttttcagcagatcttgaggttgttaccagtacttgggtgctggtgggtggtgtgctcacaaactactgtgatgccattggggtgcgcaagagtatcgcaagcgccgccaatcctatattgctttccgcgctgtcaggtggacgcggcgatatatttcctccttaccggtgctctggcgcaaccacctcagttggacgggttttcccactctccgctgatctggaagtggttactagtacctgggtccttgtgggcggcgtgctgtcagtgtctctctctatgtccctcatctccaagacatcagaaatcattagcatgctgaccgccatcagcaaaggtgtgtacgggaaaacgtatcttctggtgcccgagtatatcgaaagagaattcgacacccagaagatccgagtgtttgagatcggtttttctgctgacctcgaagttgtcaccagtacctgggtgctggttggaggagtgctgatcaagcgctggctgaatgatatgcccctcctccaaaccacaaactatatggtgctccccgaaaacagcaaggcaaaggtgtgcaccatcgcggtcggggaactgactctggcctccctgtgcgtggacgaatccactgttttgctgtatcacgattcagctgatctcgaagtagttaccagcacctgggtcctcgtcggtggtgtgctgagcaacggtagccaagactctatccttgtcgtgacattgggcatcttcggagccacacccatgaatcaggttgaggaggtgatcccggtggctcacccaagcgtcgagagaatccacattacgaaccaccgggggtttattaaggactccgttgcgacatggagtgcagatttggaggtcgttacttcaacctgggtgctcgtaggaggcgtcctcatggtgccagctctggtctctgagcaacaggagggccagaagaactgtctggaaagcgcttgtcagcggaaatcatatccaatgtgcaaccaaacatcatgggaaccattcgggggagtacaactcccttcctacggaagactgactctctctgctgatctcgaggtggtgacaagcacatgggttctggtgggtggcgtcctgccactggatgcctccatcgacctccagctgaacataagttttacctacggccccgtgattcttaacggagacggaatggactactatgagaatcccctgcttgatagtggatggctcaccataccgcccaagaacggcacaattcttggcctgatcaacaaggcctctgcggacctggaagtggtgacatctacctgggttcttgtgggcggagtgttgtcaagaggcgatcagttcaccgttacccctcacgtactcacatttgctccacgagaatcatctggaaactgctatcttcccatccaaacatcccagattatggataaagatgtgctgactgagagcaacctcgtggtgctcccaacacagaacttccggtacagtgcagacctcgaagtagtaacgtcaacgtgggtcctcgtgggcggagtcctcgtggttgctacatacgacatcagtcgggaaaaccacgcaatcgtatactatgtgtatgaccctatacgcactatcagttatacatatccctttcggctcactacaaagggccggccagattttctgagaattgagtgtttcgtgtgggacgatgatctttggtgtcacagcgctgacctggaggtggtgacctctacatgggtgctggtcggaggggtgctccagttctacaggtttgagtcagacattaccaatagcaccacaagtgtggaagatctggttagaattcgattcagctgcaaccgctccaaaccc

SEQ ID NO: 1037 - DNA, 4776 bp, Artificial Sequence
  CDV-F Canine Distemper Virus
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgcacaataagatcccaaaaaggtcaaatacaagaacccacacacagcaggatcttcctcctcagcccagcacgaagtcagccgagaccaagacttcacaggcccgccatagtatcacatctgctcggcgctccacgcaccatgatagcgcagatcttgaggttgttacttctacgtgggtgctcgtgggcggtgtgttgcctcttacatcagacaggcccatccactacatcatgaaccgcattcggtcttgcaagcaaacttcctatcggtccgacaatataccggctcatggtgaccatgagggtatcattcaccacacgcctggatccgtgccacagggatccggatcttctgcagacttggaagtggtgacctccacgtgggtccttgtaggcggggtgctccaaatcaaacgccggcagagcaacgccattaacagcggaagtcagtgcacctggcttgtcctgtggtgcattggcgtggcgtcactcttcctgtgcagcaaggctcagatccattggaacaatctgtcaacgataggcataattggcactgacagctctgccgacctggaagtagtgacatcaacctgggtcttggttggcggcgtcctcgtccactataagattatggccagaccctcccatcagtatctcgtaatcaaattgatgcccaatgttagtctcattgagaattgcacaaaagcaaaactcggcgagtacgagaaactcctgaactctgtacttgagcccataaaccaggccctgactctcagcgccgatttggaggtggtgacctcaacctgggtgcttgtcggtggcgttctgatgaccaagaatgttaagccgctgcaatctctggggtctgggagaaggcagcgaagattcgctggcgttgtgcttgcgggcgcagctcttggggtcgccaccgccgcacagatcactgcgggcatagcacttcaccaatccaatctcaatgccagcgctgacttggaggtggtcacctctacatgggttctggtgggcggggtgcttcaggcgatccagtctctgaggacctcactggaacagagcaataaggccatcgaggagatccgcgaagctacccaggagaccgtcatcgcagtgcagggtgtccaggactacgtgaacaacgaactcgtgcctgctatgcagcatatgagctgtgagagcgccgatctcgaggtggtcacttctacatgggtcctggtgggaggtgtgttgctggtggggcagaggcttgggctcaaacttttgcggtactatacagagctccttagtatcttcggcccctccctccgggaccccatcagcgctgaaatttctattcaggctttgtcctatgcgttgggtggcgagatacataagatactggagaaactcgggtactctgctgatctggaagtggtcaccagcacctgggtgttggtaggtggcgtcctgtctgggtccgatatgattgccatattggaaagtagagggatcaaaactaaaatcactcacgtggatctgcccggcaagctcatcatcctgtctattagctatcctactctgagcgaagtaaaaggggttatagtgcaccgcctggaagctgtcagctataacatttcagcagacctcgaagtggtcactagtacttgggtgttggtgggcggcgtcctgggtagtcaggagtggtacaccacggtgcccagatatgtcgccacaaatggatatctgatcagcaacttcgatgaatctccctgcgtcttcgtcagtgagtcagctatctgctcccagaatagcctgtaccctatgagcccactgctgcaaagtgccgatcttgaagtggtgacttccacctgggtcctcgtgggaggggtactccaatgcattcggggggataccagtagttgcgccaggactctggttagcggcaccatggggaataagttcatactgtccaaaggcaacatagtagccaattgcgcctcaattctctgtaaatgttattctaccgggactatcattaaccagtcaccagactctgctgatttggaagttgtgaccagcacatgggtccttgtcggcggcgttctgaaactccttactttcattgccagcgacacgtgcccattggtcgagatcgatggcgtgactatccaggttggaggaaggcagtaccccgacatggtgtacgagtccaaggtggctcttggtcccgcgatcagtctggaacgcctcgacgtgggtacttccgcagacctggaggttgtcactagcacatgggttttggttgggggagtgctgaatctcgggaatgcactgaaaaagctggatgatgctaaagtcctgattgacagctctaaccaaatactggaaaccgtgcgccggtcttcattcaattttgggtccctgctgagcgtacctattctgatttgcaccgccctcgccctcagtgccgatctggaggttgtgacctccacttgggtgctggtcggaggggtgctcctgcttctcatctattgttgcaagaggcgctaccaacagacccttaagcagaacgccaaagtagaccctgcattcaagcccgacctgacagggactagcaagagttacgtccgcagcctcagtgcggacctggaggtagtcaccagtacgtgggtcctcgtaggaggtgtcctg

SEQ ID NO: 1038 - DNA, 2730 bp, Artificial Sequence
  Birch Allergen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgggagtgtttaactatgagacggagacaaccagcgtaataccggctgcccggctgtttaaggctttcatccttgacggcgataatctcttccctaaggtggccccgcaggctatatccgccgacctggaggtggtcacatccacatgggtccttgtcggaggcgtcttgagctctgtggagaatatcgaggggaacggtgggcctggcacaatcaagaaaatctcctttcccgaggggttccccttcaagtatgttaaagacagggttgacgaagtggaccactcagctgatctggaggttgtgacaagcacatgggtgctcgttgggggagtgctgactaactttaagtataattacagtgtgatcgagggggggccaattggagataccctggaaaagatctctaatgagattaagattgttgcaaccccagatggcggtagtatcctgaaaatctcttccgccgatctggaagtcgtgaccagcacatgggtactggtgggaggtgtcctcaataagtatcacacaaaaggcgatcacgaagttaaagcagagcaggtgaaggcctccaaggaaatgggcgagacactgctccgggctgtagaaagctacttgctcgcccactccgatgcatataat

SEQ ID NO: 1039 - DNA, 2790 bp, Artificial Sequence
  Dog Dander Allergen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgcaacttttgctcctgaccgtaggactggctttgatttgcggtctgcaagcacaagagggtaatcacgaggaaccccaaggtgggttggaggaactgtcaggcaggtggcactccgtggcactggcctcctccgctgacctggaggtggtgacctccacatgggtgctggtgggcggagtcctgaataagagtgacttgatcaagccatggggccatttccgcgtgtttatccattctatgagtgcaaaagacggaaacctccatggcgatatcctgattcctcaggatggtcaatgtgagaaagtgtctcttaccgcgagcgcagatctggaagtggtaacctctacttgggtgctggtcggcggtgtgctgtttaagacagcgactagtaataagttcgatctggaatattggggtcataatgacctttacttggccgaggtggatccaaaaagttaccttattctgtatatgattaaccagtacaatgatgatacatcccttgtagcatctgctgacctggaagtcgtaactagcacctgggtgttggttgggggagtgctccacctcatggtccgcgatttgtcaaggcagcaggattttctgccggccttcgaatcagtgtgcgaagatataggattgcataaggatcagatagtggtcctgtctgatgatgataggtgtcagggctcacgggac

SEQ ID NO: 1040 - DNA, 3138 bp, Artificial Sequence
  Johnson grass pollen (Sorghum halepense)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgagttggtctatgcaggttgcactggttgtggccctcgcctttttggtcggtggagcttggtgcggacccccaaaggtggctcctggaaagaacataaccgcaacttacggtagtgattggctttcagcagacctcgaagttgttacgtccacttgggtcctggtcggcggggttctcgagaggaaggccacatggtatggcaagcccaccggagccggacccgacgacaatggaggagcctgcgggtacaaagacgtaaacaaggccccttttaatagcatgggagcatgcggcaacctgtccgctgatctggaggttgttacttccacctgggtgcttgtcgggggtgtccttcctatattcaaagatggactcggttgcggttcttgctttgaaatcaagtgtgacaagcctgccgagtgctcaggagaagcagtcgttgttcacataacggatatgaacgaacagatagctgcctaccattttgactcagccgatctggaagtggtcacttctacctgggtcttggtggggggggttctgctcgctggcaccgctttcggtgccatggctaagaaaggcgaagaggagaaactgaggaaagccgggatcatcgacatgaagttccggagagtgaaatgtaagtatggggagaaggtgacgtttcacgtggaaagtgccgatctggaggtcgtgactagtacctgggtgttggtgggaggcgtgctgaaaggtagcaatcctaactatttggccctgctggtgaagtacgttgacggcgatggcgacgtagtgggggtggacattaaagagaaaggcggcgatgcctatcagccgttgaagcactcctggggcgccatatcagccgacctcgaagtggtgacatccacttgggttctcgtgggaggagtactgtggcggaaggactctgataaacctataaaattccctgtgaccgtgcagatcactacagagggcgggaccaaaaccgcatacgaagatgttatccctgaaggatggaaggccgacaccacctataccgccaag

SEQ ID NO: 1041 - DNA, 3738 bp, Artificial Sequence
  latex allergen (Hevea brasiliensis) (Hev b 7)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatggccacagggtctactcctttgacgcagggtaagaaaataactgtgttgtccattgacgggggaggcattcggggcatcatcccagggattatacttgcatctctggaatctaagcttcagtccgctgacctggaagtggtgacttctacctgggttcttgtgggtggggtgcttgacctggacggacctgacgcgagaatcgccgactacttcgatattatagcaggtactagcactggtgggctgattaccacaatgctgactgccccaaacgaggacaaaaagcctatgtattcagctgacctggaggtcgtcacgagtacctgggtgctcgttggtggagtcctgcaggcgaaagatatcaaggacttttacttggaaaactgcccaaaaattttccccaaggagagtcgcgataactacgaccctatacactctattggcccgatctatgacggggagtacctgagtgcagatctggaagtggttacaagcacctgggttctcgttgggggcgtgctgcgcgagctttgtaacaatctgctcaaggatctcaccgttaaagatactctgacagatgtgattattcccaccttcgatattaaacttctgctgcccgttatcttctcttctgacgacgccaaatgtagcgcagatctcgaagtcgtcacatccacctgggtactggtgggaggcgtgcttaacgccctgaaaaacgcccgccttgctgacgtttgtataagcacatctgctgctcctgtccttcttcccgcccactcttttacgacagaagatgacaaaaatatccacacattcgaacttagtgccgacctggaagttgtgacaagcacttgggtgttggtcggtggtgtcctcattgacggtggggtagccgcaacaaacccaaccctgctcgctctgacccacataagaaacgagataattcgccagaaccccagattcatcggtgccaacctcaccgaatccaaaagcaggctggtgctgtcagccgatctcgaagtagtgacaagtacttgggtcctcgtgggcggagtcctgtctctgggtacaggcaagtccgaatacaaagagaagtataatgccgacatgacctcaaagtggaggctgtataattgggctctgtacaatggcaatagccctgcttccgctgaccttgaagtggttacgtcaacttgggtgctggtgggcggcgtcctggtggacatcttctcaaatgcgagcagcgacatggtagacttccacctgtccgcccttttcaaaagtctggattgcgaagactactatctgcggatccaggatgataccttgaccagtgctgacctcgaagtcgtaacaagcacatgggtccttgtgggaggggtccttggggaagagagcagcggccatatcgcaacggaagaaaacctgcagcggctggttgagatcggcacggagctgctggaaaaacaggaatcacgcattaatctcgatacgggacggtccgccgacctggaggtggtgacgtcaacctgggtgcttgtagggggtgtcctcctggaaagcatcccaggcgctccaaccaacgaagcagctatcgccaagtttgctaaactcctgtccgaggagaggaaactgagacagctgaag

SEQ ID NO: 1042 - DNA, 3693 bp, Artificial Sequence
  latex allergen (Hevea brasiliensis) (esterase precursor / Hev b 13)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatggagtttcccgagaccaataacaatcctataattaccctgtcctttctgctgtgtatgctgtcactcgcctatgcctctgagacatgcgacttcccggctatcttcaacttcggcgacagtaactccgcagatcttgaggtcgtgacatccacgtgggtgttggtcgggggcgtacttagcgatacaggaggtaaggcggctgctttctaccccctgaatcctccttacggcgaaacatttttccaccgaagtaccgggaggtactcagacggtagactcatcatcgatttcatcgcagaatctagcgctgacctggaagtggttaccagtacatgggtgcttgtgggcggagtgttgttcaatttgccatacctgtccccttacttgagctccctggggtcaaatttcaaacacggcgctgacttcgctaccgccggatctaccatcaagttgcccacaacgattataccggctcacgggggtttctctgcggacctggaagtcgttacttccacgtgggtcctggttggtggggtcctctctcccttttacctcgatgtccagtattcccagttcagacagtttatcccacgcagccagttcatcagagaaactggtggaatcttcgccgagctcgtaccagaagagtactactttgagaaagctttgagtgccgatctcgaggttgtgacgtccacatgggtgttggtgggaggcgtattgtatacgtttgatattggtcaaaacgacctgaccgaaggattcttgaaccttaccgtggaggaagtgaacgcaactgttcccgacttggtaaactcctttagcgcaaatgtgaaaaagatctatgatctgagtgccgaccttgaggttgtgacatccacttgggttctcgttggcggcgtcctcggagctcgcaccttctggatccataacaccggtcctatcggctgcttgtcatttatcctcacgtatttcccatgggctgaaaaggatagcgcaggatgcgctaaggcttataacgaggtcgcgcagagcgccgacctggaggttgtcacttcaacttgggtgttggttggaggcgtactgcattttaatcacaaacttaaagaaatcgttgcccagctgaggaaagatcttcctctcgctacctttgtgcatgtcgacatctattctgtcaagtactccttgttcagtgagcctgagaagcacggattcgaatcagccgaccttgaagttgtgactagcacatgggtcctggtgggcggagtcttgttccccttgatcacgtgttgcggatacggaggtaagtataatttctctgtgaccgcaccctgcggtgacaccgtcacagcggatgacggaaccaaaatcgtcgtcggaagctgtgcgtgtccaagcgtcagtgccgatcttgaagttgtcacgtctacatgggttcttgtgggcggtgtactgcgagtgaactgggacggcgcacactatactgaggctgccaatgagtactttttcgaccagatctcaaccggcgccttttcagacccacctgtgccgctgaatatggcctgtcacaagacggaaagcctgcgaactttggcctcagtg

SEQ ID NO: 1043 - DNA, 2529 bp, Artificial Sequence
  fungal allergen (Cladosporium hebarum)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgaaatatatggcagcttatcttctcttgggcttggccggaaactcatctccaagcgctgaggatattaaaactgtcctctcctccgtgggtattgacgctgatgaagagtccgctgatctggaagtcgtcaccagcacatgggttctcgtaggcggtgtgttgcgcctgtcttccctgctgaaggaactggaggggaaagacatcaatgagctgatctcctctggatcccagaaactggcatcagttccgtccggcggctcaggcgccgccccatccgctgacttggaagttgtgacaagtacctgggtgctggtgggaggggtgctgtccgcaggaggtgcggccgctgctggaggggcaactgaagccgcccccgaagccgcaaaggaagaggagaaggaggaatctgacgatgatatggggttcggactgtttgat

SEQ ID NO: 1044 - DNA, 2730 bp, Artificial Sequence
  alder pollen allergen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgggcgtgtttaactacgaagctgagactacaagtgtcattcctgcagcgcggctgtttaagagttacgtgctggacggagataagctgattcctaaggttgcacctcaagcaattagcgccgacctggaggtcgtgactagcacctgggtgctggtagggggagttctgacctccgtcgagaacgtggagggtaacggcggacctggtactataaagaatattacatttggcgagggaagtcggtataagtacgtaaaggaacgggtggacgaggtggacaatagtgccgacctcgaagtcgtgacttccacttgggtgcttgtcgggggcgtcctcaccaattttacttacagctatacagtgattgaaggagacgtgcttggagacaagctggagaaagtgtgccacgagctgaagatcgtggctgcgcccggtggcggctctatccttaagatttcagccgatctggaggtggtaaccagcacctgggttctcgttggtggagtgctgtcctccaagtttcacgccaaaggggaccacgagatcaatgccgaagagatgaaaggggcaaaggagatggccgagaagctgttgcgcgctgtggaaacatatctgctggcgcatagcgcagagtataac

SEQ ID NO: 1045 - DNA, 3513 bp, Artificial Sequence
  vespid venom allergen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcagtgaaagacccaagcgcgtgtttaatatctactggaatgtccccactttcatgtgccatcagtacggactgtatttcgacgaagttaccaactttaatatcaagcacagtgccgacctcgaggtggtcacctctacttgggtgttggtaggcggagtattgaattctaaagatgatttccagggagacaagatttcaatattctacgatcccggcgagtttcccgccctgctcccactgaaggaggggaactacaagatccgaaatggtggcagcgcagatctggaggtggtaacaagtacatgggtgctcgtcgggggcgtgctggtgccgcaggaaggcaacatcaccatccatctgcagagattcattgaaaatctggataagacttaccccaaccgaaacttcaatggaattggagtgattgactttgagagatggtctgccgaccttgaggttgtgacatccacatgggttttggtgggtggggtactccgacctatctttcggcagaattggggcaacatgatgatccataagaaattcagcattgacctcgtgagaaacgagcatcctttttgggacaaaaagatgattgaactggagagcgcggacttggaagtcgtgaccagtacatgggttctggtcggaggggtgttggccagtaagcgcttcgaaaaatatgccaggctcttcatggaagagacattgaaactcgctaagaagactcgcaagcaagccgactgggggtattatgggtacccctacagcgccgacttggaggtcgttacctctacctgggtccttgtgggcggtgtgctctgtttcaatatgtcaccgaacaatctggtccccgactgtgacgctactgcaatgctcgaaaatgataagatgagctggctcttcaataatcagaatgtgctgctgccgtcagcagacctggaagttgtcactagcacctgggtactggtgggtggcgttctgtccgtctacattaggcacgaactgacacctgatcaacgggtcggactggtgcagggacgagtcaaagaggccgtgcgaatctctaacaatctcaagcattccccgaaggttctgagcgccgaccttgaagtggtcacgagcacctgggtgcttgtcggaggcgtgctctcttactggtggtacgtttaccaagatgacactaatacatttctgacagagactgatgttaaaaagacatttcaggagatcgctatcaacggcggcgatggtattatcatctggggaagcgctgacctggaggtcgtcacatctacctgggttctggtgggcggtgtacttagtagcagcgatgtgaattccttgtcaaagtgtaaacggctgagggagtacctgcttacagtactgggacctatcactgtgaatgttaccgagaccgtaaac

SEQ ID NO: 1046 - DNA, 3543 bp, Artificial Sequence
  dust mite allergen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggctttgtcatgaaacgcgagcctctgagatttcgagatatcacagtcgagggaaacgagaacgcgtatatcaaaaacggtaaactgcatctctctctgatggaccccagtgccgacctggaggtggtcacatctacatgggttcttgtgggaggagtgctgagcacactctcactggtgaccaaggccgacggcaaaatcgacatgactgtggatctcattagcccagttaccaaaagagctagcctgaagatcgatagcaaaaagtacaatagcgcggatctggaggtcgttacaagcacttgggttctggtgggcggggtcctccttttccatgagggagagctttctgcctctatagtgaacccgcgattgagctggcaccagtacactaagcgagactctagggaatacaagtcagatgtggagctctcatccgccgatctggaggtggtgacgagtacttgggtgttggtgggcggcgtgctcctgcgcagcagtgacatcgcactgaagatcactatgcccgactacaactctaaaatccactactctcggcagggggaccagattaacatggacatcgacggaacattgatcgagggttcagccgatctggaagtggtaactagcacatgggtattggttggaggcgtgctccatgcacaggggacaattagagaggggaaaatccacattaaaggacgacagaccgacttcgagatcgagtccaattatcgatatgaagacggcaagctcattatagaaccagtcagcgccgacttggaagtggtcacatccacatgggtgctcgtgggcggggttttgaagtccgagaacggcaaactcgagggagttctctctcggaaagtcccttctcatctcacgttggaaactcccagggtgaagatgaatatgaaatatgaccgatatgcaagtgccgatttggaggtcgtgaccagcacttgggtcctcgtcggtggtgtgcttcctgtgaaggtattcaagctcgattacgacggcattcatttcgaaaagcacacagatatcgaatacgagcccggcgtcaggtataaaattattgggaacggaaagctcaaggatgactccgccgacctcgaagtagtgacctccacttgggttttggtgggaggggttctgggccggcactattccatcgatgtgcagggcatcccacgcaaagctttcaatttggacgctgacctgatggatttcaaattgaaggtgagcaagcctgaagacagtaataaggcttcagccgacttggaggttgtgactagtacctgggtgctggtcgggggagtcttgcaattctcttacaccttcaatgaatacaccgagacagaagagtatgagtttgatccccaccgagcatattatgtcaattggctgagtagtatcagaaaatacatacagaatttcattgtcgaggacaat

SEQ ID NO: 1047 - DNA, 2763 bp, Artificial Sequence
  Lyme Disease agent (borrelia burgdorferi) OspF Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgaacaaaaagatgaaaatgtttattgtatatgcagtgtttatcctcatcggggcttgtaagatccatacaagttacgatgaacaatcttctggagaatccaaggtgaagaaaatcgagttctcagcagatctcgaggttgtgaccagcacatgggtcttggtgggaggagttctgagtaagtttactgttaagataaagaacaaggataagagcgggaactggactgatctgggtgaccttgtggtacgcaaagaggaaaacgggatcgacacaggcctcaacgccggaggcagcgccgaccttgaggtggtcacctcaacgtgggtattggtgggcggcgttcttcacagcgccacttttttctccctggaggaagaggtggtcaacaattttgtgaaggtgatgacagaagggggcagctttaagacttctctgtattacggatataaagaggaacagtctagtgcagacctggaagtagtcacctctacctgggtgttggtgggaggggtgctggttatcaacggcatacagaacaaggaaattatcaccaagatcgagaagatagacggcacagagtacataacctttagtggggataaaatcaaaaactcaggggacaaagtggctgagtatgccatcagcttggaggagctcaagaaaaatctgaaa

SEQ ID NO: 1048 - DNA, 3048 bp, Artificial Sequence
  Lyme Disease agent (borrelia burgdorferi) OspE Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgaataaaaagatgttcattatctgcgccatatttgccctgattgttagttgcaaaaactacaccacaagcaaggatctggagggatccgtgcaggacctcgaaagcagcgaacagaatgcatcagccgacttggaggtggtcacgagcacttgggtgctggttggaggagtcctcaagaagacggagcaggagatcaaaaagcaggtagaagggttcctcgaaattttggaaacaaaggatctgaatactttgaatactaaggacatcaaggaaatcgagaaacagatccaggaattgaagagcgcagatcttgaagtggtaacctcaacctgggtgctggttgggggtgtactcgacaccattaataagttggaggcaaagaagacatccctgaaaacttacagtgagtatgaagaacagattaagaagatcaaggagaagcttaaggataaaaaggagctggaggacaaactcaaagagagtgctgatctggaagtggtgacatcaacatgggtgctcgtgggcggcgtgctccttgaagaatccctgaagaagaaaaaggaggaaaggaaaaaggctctggaggacgctaagaaaaagtttgaagagtttaaaggccaagttgggagcgcaaccgggcagacccagggctccgccgacctggaggtggtgacttctacatgggttctggtgggaggcgtactccagcgggcaggtaaccaaggtcaagtgggccaacaggcatggaaatgcgccaatagcttgggactcggcgtcagttactccagcagcaccggcactgactcaaacgaactggcatccgctgaccttgaagtcgttacaagtacctgggtcttggtcggcggggtcctgaataaggtgatcgacgacagcatcaagaagatcgacgaagaacttaagaacaccattgagaataatggtgaagtgaagaaggag

SEQ ID NO: 1049 - DNA, 3879 bp, Artificial Sequence
  Lyme Disease agent (borrelia burgdorferi) S1 Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgaacaagatcggcatcgccttcattattagctttctgctgttcgttaattgccgggggaaatctctggaggaggatctcaagagtactacatctaacaacaagcagaatcttatttctgctgatctggaggtagtgactagtacctgggtcctggtaggaggggtgttgtccaatgagaagaaatccttgaatagcaaaaacaacagactgaaggactcacggctctctaattttgagtccaagaagaacgaccagactctcaagaagagtaaagacagtgctgaccttgaagtggtgacatcaacctgggtgctcgtcgggggtgttctctttaaaaaggacctccagacactgcggaacagcaaaaacctcatgcccaaagacctcgatcagagttccaacgacttcgagaatctggacaactctgagtctttgcaatcagccgacttggaggtggtaaccagcacatgggtccttgtaggtggcgtcctcgaggccagcagcaagcataacattggaaagagtagatacggtaaagctctgctcaaaaatgatcatgacgagatatggattccccatctgaacctcgaggaggataagaactttgagtctgcagatctcgaggtcgtgacaagcacctgggtactcgtcggtggggtgttgttcttcaaaaagagcctgcagaatgacgagaacaggtatgctcttggcggctggctgctgaataatgacgaagttctcgtgaagtacaggtattcagaaaaagatgtgaattcagctgatctggaagtcgttacttcaacgtgggtcctggtgggcggtgtgctgcagtttctgatcgatatcggcaagaaaagatggggcgatctctcctccaaaatgagtacccttgtaaggcttatcggtaactacagcgataagagcgacagagaggatgaaatttcttcagccgaccttgaggtggtaacaagcacttgggtcctcgtcggaggagtcctgctcctggacatgaatttgtgtcagcagttttaccttacaaaaataaatgccgggggttcatccgctgacatccttgttgcgctggaaaagactatcgatcagcagatttccggtgtgagtaagagtgcggacctggaagtggtgaccagcacttgggtgctggtgggtggtgtgctcgagcttcttgagttgaagaattttagtcttactaccaaatccgagctggattggtatcttaactggaaaagaaatctcacggacgaggaggaggagacgcttcagtgttgtagggtccttagcgcagacctggaagtcgtcaccagtacttgggtgttggtcggtggagtcctgctcgggggcgagctcgacttcgaaaacctggatgacctgtttaaaaggctgggaaaagagtattctcgactcatactcagaaagctggaggaaatcactctcaactatgatgtcaacagatttctcaaatctgcggacctcgaggtagtcactagcacatgggttctggtcggtggggtcctcgagatggagaaatctcgaaagtctttcaagcaggcgctcggttccattcgcaataaatccaagagagttgtgatttttaaggttcggaatagtcttcttgaaattttcaagctgtactacaataatagtgctgacctggaggtggtcacctccacgtgggtccttgtcggcggcgtccttattggcagaaataagaaactgtatgattatatcaatcgaatgttgaactctctgatcaaggagatcagcaggcgc

SEQ ID NO: 1050 - DNA, 3129 bp, Artificial Sequence
  Lyme Disease agent (borrelia burgdorferi) OspD Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgaagaagctgataaagatactgctgctgagtctgttcctgcttctctctatcagttgcgtgcatgataagcaggagctttcatccaagtcaaacttgaataatcaaaagggatacctggacaatgaaggaagcgcggatctcgaggtcgtaacttctacttgggtgcttgtcgggggtgttctggcaaactccaactatgagtcaaagaaacagtccatcctgtcagaattgaatcaacttctcaagcaaaccaccaattcattgaaagaggctaaaaataccacggataatctgaacgcctccaacgaatcagccgacctggaagtcgtgacctccacctgggttctggtgggaggcgttctcgccaacaaggtggtggaggccgtgattaacgccgtgaacctgatttcatccgcggctgatcaggtcaagtcagctacaaagaacatgcacgacctggcccaaatggctgagatagaccttggcaagagcgcggaccttgaggtggtcaccagcacgtgggttttggtcggcggtgttctgatcaagaattcatccgataaagcaatcttcgcaagcaacctcgcaaaagaggcatattctctgacaaaagcggcggagcagaatatgcagaagctgtacaaagagcagcagaaaatttctgaaagcgagtctgccgacttggaggtcgtgacttccacgtgggtcctcgtgggcggcgtcctgagcgagtctgactatagcgatagcgccgagataaagcaggccaaagaggctgtggagatcgcttggaaggcaacagttgaggctaaagataaactgatcgacgtggaaaatacagtgaaagagacgctgtccgctgacctggaggtcgtcacctccacttgggtcctggtgggtggtgtgctggataaaatcaaaaccgaaacaacgaataatacaaaactcgctgacattaaggaagctgctgaactggtgcttcagatcgctaagaatgcgaaagaaatcgtgcagcaggtggtggccctgcttaacacc

SEQ ID NO: 1051 - DNA, 2772 bp, Artificial Sequence
  Lyme Disease agent (borrelia burgdorferi) EppA Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgcgcaaaatctcactcctcctgtttctgctgtttatgctgtcaatcgacctgtccgcattcatgagccaagacatcaaaaagaactatgaaaaggccaagaaggcgttttctaaagaggattatgacctgtctgccgacttggaagttgttaccagcacctgggtcttggtaggcggcgttcttttgaacaaacgcctggacaactacgactttgagtccgagtatgacaagtcttttttctttgccaaagcccctgagattcgggggagcttgaggaagattggcattaaagaaaacagtgttcttcttgacgctagcgcagatctcgaggtggtgaccagcacttgggtcctcgtgggtggagtactcttggacgtagtgggctttattaagtcaaaaattaccacggacttcctgtcctttatcatcatgaacataaactccctgataaaaggttaccctaacagcatctttgattacctcattcaactggactctgataagatagattccgcagatctggaagtcgtgacaagtacttgggtgctggtcggtggggtgctttatgcggaaaagtacggcgagaaagccagggaaaacttcgaggaatcctacaaaaaggataagattactgcagttaagcaaatcctcaaacaaattctcgcagacctccccaaggac

SEQ ID NO: 1052 - DNA, 4614 bp, Artificial Sequence
  Rinderpest Virus - Hemaggluttiin
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgtcctcacccagagacagagttaacgccttctacaaagataatctgcagttcaaaaacaccagagtggtgcttaataaagagcagctgctgattgaacgaccctacatgctgctggccgtactctttgtcatgtccgctgatctggaggtggtgacatcaacttgggtcctggtcggtggagtactgtttctgagccttgtgggactgctgacaatcgccggaattcggcttcaccgagccgctgtcaacaccgccgagataaacagtggcctcacgacctccattgatgtcacaaagtcaattgagtatcaggtgaaagacagtgccgacctggaggtcgtgactagcacatgggtgctggtgggcggagtgctcgtgcttacgcccctttttaagattattggcgatgaagttgggctcagaacaccacagcgattcaccgatctgacgaagttcatctcagataaaatcaagttcttgaaccctgacaaggagtaccacttcagggattccgctgatcttgaagtggtgacatctacttgggtcctggtaggaggtgtcctgatcaactggtgtatcaacccgcctgaaaggatcaaaatcaattacgatcagtactgcgcccatacagccgccgaagacctcatcactatgcttgtgaacagttctcttgccgggccacccgtgttgcggactagctcagccgacttggaagtggttacttccacatgggtgctcgtgggaggtgtgttgagtgtgaagctccggcgaaactgtaccggacccaccactactaagggacaattttcaaatatgtcactcacactgtcaggtatttattcaggccgcgggtacaacatctcctccatgattactattactgaagagagcgcagacctggaagtggtgacttccacctgggtccttgtgggcggcgtcctgatgtacggatccacctatctcgtgggaaaatactcccagcgcgctagaaagtcttccacgggttggcagcaggattaccgagtgttcgaggtgggaattatcagagaattgggggtgggcacgtccgccgacctggaagtagtcaccagcacctgggttctcgtcggtggagtgctgcccgtttttcatatgacaaactatctcgagctgcctaggcagccagaactcgaaacttgcatgctggcacttggggagtctaagttggctgctttgtgtttggccgattctccaattgcgttgcactacggttctgctgacctcgaggtggttaccagcacttgggtcctggttggcggcgtgcttggcgccggagacgataataggattaagttcattaaactcggcgtgtgggcttctcccgccgatcttgacacattggccatactgtctgccatcgatccaaagctggacggactttacataacaacacacaggggaattatcagtgccgacttggaagttgtgacatcaacctgggtcctggtggggggggtactggttgcaggaaaggccatttgggccgtgcctgtgacgcgaaccgacgaccagctgcgcatgggaaaatgccgcctggaagcatgtagagataaacctcctcccttttgcaacagcacagactgggagccttctgcagacctggaggtggtaacctccacttgggttctggtcggaggagtgctgctggaagccgggcgcatacccgcctatggggtcttgaccatcagactgggcctggcggataagccggaaattgatattatctcagaatttggaccgttgataacacatgacagcgggatggacctgtacaccagctcagactccgctgatctcgaagtggtgaccagtacttgggtgctggtaggaggggttttgggcaacgagtactggcttacaatacccccgctgcaaaactccgccctcggcacggtgaacactctcgtgctggaacccaggctgaagatctctcccaatatcttgactcttcccataaaaagtgggggcggtgattgcagcgcagatctggaagttgtcacttcaacttgggtactggtgggcggcgtgctgtatacccctacttacctttcagatcgatcagatgatgacgtgaagttgtcctccaatctcgtcattctgccctctagaaacctccagtatgtgagcgccacatacgatatcagcaggattgaacacgccatcgtttattccgccgatctggaagtggtcaccagcacatgggtgcttgtgggcggtgtgctttacatatacagtacaggacggctgagttcctattattacccctttaagctcccaatcaagggggacccagttagtctgcagattgaatgctttccatggacgcgcaaattgtggtgtcaccatttttgtacagtttccgccgatctcgaggtggtgacaagcacctgggtgctcgtcggtggggtgttgatcgacagtggtaccggcgaacaggtgacacacacaggtgttgtgggtattgagatcacctgcaatcggcgc

SEQ ID NO: 1053 - DNA, 2550 bp, Artificial Sequence
  Blastomyces dermatitidis (WI-1 Protein)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcgatccttatcatgaaaagtatgactgggacttgtggaacaaatggtgcaataaggacccatacaattgtgactgggatcctagccacgaaaagtacgactgggacctttggaacaagtccgccgatctggaagtggtgaccagtacatgggtgttggtgggaggtgtactgtggtgcaacaaggatccatacaactgcgactgggacccttaccatgagaaatatgattgggatctctggaataagtggtgtaacaaagatccatataactgtgattgggatccctattccgctgatctggaagtcgttacctccacatgggtgctggtgggcggggtccttcacgagaagtatgattgggacctctggaataaatggtgtaacaaggatccttacaattgcgattgggacccttcccatgagaagtacgattgggatttgtggtccaagtggtgtaataaa

SEQ ID NO: 1054 - DNA, 2982 bp, Artificial Sequence
  Shigella flexneri ShET1 Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatggttcagagaaatattccttttatcctggctccagttatacacggggtgagagatagaggtaccttcctcagaaatgacataatcagttgttccgtgatcttcattcataagtgtccggtgacaagccagtgttccgcggaccttgaagtggttacgagcacctgggtgctggtcggcggagtgctcgatatggcaaaaatggaggtgagcgtcttccagagacagtgcttccattgtaagttgaccgttttcccagtgtttctggttcaggccgaccggtgcactgctacagacggcgggatggataaccggatgagcttgtccgccgacttggaggtcgttacctccacctgggtccttgtggggggggtcctcgaataccagggagctaccgtgctcacccaggggacttttcgacaggtacacgctactataaaagattacttgagctcacctcgacacctctggaacggcgatattcacatccctggacagcttacgatgaaagacagcgccgatctggaggtggtcacttcaacttgggtgctcgtgggtggcgtgttgaacggcctgttctgtccccccgagcaggaccccatattttattgtcttaactgcgttgtctttgtgcacgcaaacaagctccctctctcacgcatcatccaggccgtcccacctcagtctgtgaccattgccggctctgctgaccttgaagtcgtcacttccacttgggtcttggtgggcggggttctgcggtttcagaatattgaagctggactcgcagtggaataccatgccgttcaggtatcctggagtgcaggaaccaccaagggaggctacatcagcaatagaaggtttacagacatctgcattcttagcttgaagattcag

SEQ ID NO: 1055 - DNA, 4482 bp, Artificial Sequence
  Shigella flexneri ShET2 Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatgccatctgttaatctgatcccttcaagaaaaatttgtctgcaaaatatgattaacaaggataacgtaagtgtcgagacaatacagtccttgcttcacagcaaacaattgccgtatttctcttctgcggatttggaggtggtgacctcaacgtgggtgcttgtcggcggggtcctggacaagagatctttcttgctcaacctcaactgtcaggtgaccgatcattccggcaggttgattgtgtgtagacacctcgcatcttactggatagcccagttcaacaaaagttcaggccatgtgtccgccgacctcgaagtcgtcacctctacgtgggtgctcgtcgggggcgtgctggactatcatcacttcgcattcccagacgagattaaaaactacgtttcagtatcagaagaggagaaggccatcaacgttccggcaatcatttacttcgttgaaaacggctcttggggcgatataagtgctgaccttgaggtcgtaaccagcacatgggtcctggtcggtggcgtgctgatcttctatattttcaacgaaatgattttccactctgagaagagtcgagcactggagatttccacaagcaaccacaatatggcattgggcctgaagataaaggagactaaaaatggaggggatagtgctgacctggaggtggtcaccagcacgtgggtactggtgggcggcgtgctcttcgtgatccagctgtacgaccccaaccataccgccactcatctgcgcgccgaattcaataagttcaatctcgccaaaatcaagaagcttacggttgataattttctggatgagaagcatcaaagcgccgatcttgaggttgtcaccagtacttgggtgttggtgggtggggtgttgaagtgctacggacttatatcagacgggatgagtatatttgtcgacaggcatactccaacaagcatgtcatccattattaggtggcccgacaatctgctgcaccctaaggtaatctaccatgcctctgcagatctggaagtggtcacaagtacatgggttctcgtcggaggagtgttgatgcggatgggcctcacagagctgattcagaaagtgaccagagtggtccagctgtctgacctgagcgacaataccctggagttgttgttggcagccaaaaacgacgacggcctgtccggtctgtcagccgatctggaggtcgttacatcaacatgggttcttgtgggaggagttctcctcctggctctgcagaatggacactctgacaccattttggcctacggggaacttctggagacatccggacttaatctcgacaagacagttgagctgctcaccgctgagggcatggggggccggagtgccgatctcgaagtggtgacatctacgtgggttctggtgggaggagtcctcatttcagggctgtcacaggcactccaaaatggccacgccgagacaatcaagacatacggaaggctccttaagaaacgcgccaatatcgaatataacaaactgaagaacctcctgacagcatacagcgctgatttggaagtggtgacttccacatgggtgctcgtaggaggggttttgtattatgatgaagttcaccggcagataccgggcctcatgttcgccctccagaatggccacgctgatgctatacgggcctatggtgagcttattctctcacccccgcttctgaatagcgaagacagcgccgatctcgaggtggttacgtccacttgggttctggtcggaggtgtgttgattgtgaatctgctggcctctcggcggtacgacaacgtgcctggactcctcttggctcttaacaatggacaggcagacgcgattctggcatacggtgatatcctgaatgaggccaagctcaactccgcggatcttgaagttgttacttcaacctgggtgctggtggggggggtgctgcttgacaagaaggccgaactgctggaagcaaaggatagcaatgggctgtcagggttgttcgtggcacttcacaacggatgcgtggaaaccatcatcgcctatggaaagattttgcatacagccagcgcagacctcgaggtggtcacatctacctgggttctggttggtggagtgctcgacttgaccccgcaccaggctagcaagctgctcgcagctgagggaccgaatggagtaagtggtctgatcatcgcctttcagaacaggaacttcgaagcgatcaaaacttacatgaagagcgctgatctggaggtggttacctctacttgggtgctggtaggcggggttctcatcattaagaatgagaatatcacaccagaggaaatcgccgagcacctggataagaagaacggctcagattttctggagatcatgaagaacatcaaatcc

SEQ ID NO: 1056 - DNA, 2514 bp, Artificial Sequence
  Picornavirus - Polyprotein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggctctagggatgctctgccaaatactgaagcctcaggtccaactcatagtaaagaaatcccagccctgaccgccgtggagacaggggctacaaacccactcgttccctctgactcagccgacttggaagttgtgacgtctacctgggtactggtcgggggcgtgctgacagtacagactcgccatgttgtgcagcatcggtcccggagcgaatccagcatagagagcttctttgcacggggagcctgtgtaacgataatgaccgttgacaatcccagcgccgatcttgaagtcgtgacaagcacttgggtgttggtgggaggggtactggcaagtacaactaacaaggataagctctttgctgtttggaaaatcacctataaggacacagtccagttgcggcggaagctcgaattcttcacttacagt

SEQ ID NO: 1057 - DNA, 2565 bp, Artificial Sequence
  Cryptosporidium parvum - Surface Antigen
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcaagttgcttaccatgaagttggatgaagttgttgagctgcttcccgctcggaagcgcaggaagattgcaaggggatgtctgaataggcggaccgccgctttcatagccaagcttaggaagtcatctgccgatctggaggttgtcacctccacatgggtgctcgtgggaggtgtgctgaaagctgagtgccctatgggcgagaagccagtcgctgttcgcacccacttgcgaaacatggtgatcctccctgaaatggtgggttctgtagccggtgtctataacgggaaaacttacgtgacctccgccgatctcgaggtggttacctccacctgggtcttggttggcggcgtcctggtcgagattaaaccagaaatgattggcatgtatctgggcgaattctccatcacctataagcctgtacggcacggcaaacccggagtgggatccaccagcagctcaaggttcattcctttgaaa

SEQ ID NO: 1058 - DNA, 2598 bp, Artificial Sequence
  Rotavirus - VP8 Protein
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggccctacaacatttacacctccgaacgactactggatcctgattaactcaaacacgaacggcgtagtgtacgaatcaacaaacaacagcgacttctggaccgctgtcgttgccattgaaccccacgtaaatccctcagctgacttggaagtagtgacctccacctgggtcctggtagggggcgttctcgtggacaggcagtacatgatattcggagagtccaagcagttcaatgtatctaatgactctaacaagtggaaatttctcgagatgttccggagctcctcccaaaatgaattttacaaccgacgcactctgacaagtgccgaccttgaggtggtgacaagcacctgggtgcttgtgggaggagttttgagtgatacccgcttggtgggaatattgaagtacggaggccgggtttggacttttcacggggagacaccacgggcgaccacggactcctccagcgccgccaacctcaataacataagtatcactatccattccgaattc

SEQ ID NO: 1059 - protein, 1310 aa, Artificial Sequence
  EHV-1 Glycoprotein D
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMPAVLLVLYVNPPPSVCILTQKLSLGLYNQWWRVCRSVPPPWYVFFSADLEVVTSTWVLVGGVLNKRSMSTFKLMMDGRLVFAMAIAILSVVLSCGTCEKAKRAVRGRSADLEVVTSTWVLVGGVLQDRPKEFPPPRYNYTILTRYNATALASPFINDQVKNVDLRIVTATRPSADLEVVTSTWVLVGGVLCEMIALIAKTNIDSILKELAAAQKTYSARLTWFKIMPTCATPIHDVSYSADLEVVTSTWVLVGGVLMKCNPKLSFAMCDERSDILWQASLITMAAETDDELGLVLAAPAHSADLEVVTSTWVLVGGVLSASGLYRRVIEIDGRRIYTDFSVTIPSERCPIAFEQNFGNPDRCKSADLEVVTSTWVLVGGVLTPEQYSRGEVFTRRFLGEFNFPQGEHMTWLKFWFVYDGGNLPVSADLEVVTSTWVLVGGVLQFYEAQAFARPVPPDNHPGFDSVESEITQNKTDPKPGQADPKPNSADLEVVTSTWVLVGGVLQPFKWPSIKHLAPRLDEVDEVIEPVTKPPKTSKSNSTFVGISVGLGSADLEVVTSTWVLVGGVLIAGLVLVGVILYVCLRRKKELKKSAQNGLTRLRSTFKDVKYTQLP

SEQ ID NO: 1060 - protein, 1501 aa, Artificial Sequence
  Canine Distemper Virus - CDV-H
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMLSYQDKVGAFYKDNARANSSKLSLVTEEQGGRRPPYLLFVLLILLVGISADLEVVTSTWVLVGGVLLALLAIAGVRFRQVSTSNVEFGRLLKDDLEKSEAVHHQVMDVLTPLFKIISADLEVVTSTWVLVGGVLGDEIGLRLPQKLNEIKQFILQKTNFFNPNREFDFRDLHWCINPPSKIKVNFSADLEVVTSTWVLVGGVLTNYCDAIGVRKSIASAANPILLSALSGGRGDIFPPYRCSGATTSVGRVFPLSADLEVVTSTWVLVGGVLSVSLSMSLISKTSEIISMLTAISKGVYGKTYLLVPEYIEREFDTQKIRVFEIGFSADLEVVTSTWVLVGGVLIKRWLNDMPLLQTTNYMVLPENSKAKVCTIAVGELTLASLCVDESTVLLYHDSADLEVVTSTWVLVGGVLSNGSQDSILVVTLGIFGATPMNQVEEVIPVAHPSVERIHITNHRGFIKDSVATWSADLEVVTSTWVLVGGVLMVPALVSEQQEGQKNCLESACQRKSYPMCNQTSWEPFGGVQLPSYGRLTLSADLEVVTSTWVLVGGVLPLDASIDLQLNISFTYGPVILNGDGMDYYENPLLDSGWLTIPPKNGTILGLINKASADLEVVTSTWVLVGGVLSRGDQFTVTPHVLTFAPRESSGNCYLPIQTSQIMDKDVLTESNLVVLPTQNFRYSADLEVVTSTWVLVGGVLVVATYDISRENHAIVYYVYDPIRTISYTYPFRLTTKGRPDFLRIECFVWDDDLWCHSADLEVVTSTWVLVGGVLQFYRFESDITNSTTSVEDLVRIRFSCNRSKP

SEQ ID NO: 1061 - protein, 1592 aa, Artificial Sequence
  Canine Distemper Virus - CDV-F
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMHNKIPKRSNTRTHTQQDLPPQPSTKSAETKTSQARHSITSARRSTHHDSADLEVVTSTWVLVGGVLPLTSDRPIHYIMNRIRSCKQTSYRSDNIPAHGDHEGIIHHTPGSVPQGSGSSADLEVVTSTWVLVGGVLQIKRRQSNAINSGSQCTWLVLWCIGVASLFLCSKAQIHWNNLSTIGIIGTDSSADLEVVTSTWVLVGGVLVHYKIMARPSHQYLVIKLMPNVSLIENCTKAKLGEYEKLLNSVLEPINQALTLSADLEVVTSTWVLVGGVLMTKNVKPLQSLGSGRRQRRFAGVVLAGAALGVATAAQITAGIALHQSNLNASADLEVVTSTWVLVGGVLQAIQSLRTSLEQSNKAIEEIREATQETVIAVQGVQDYVNNELVPAMQHMSCESADLEVVTSTWVLVGGVLLVGQRLGLKLLRYYTELLSIFGPSLRDPISAEISIQALSYALGGEIHKILEKLGYSADLEVVTSTWVLVGGVLSGSDMIAILESRGIKTKITHVDLPGKLIILSISYPTLSEVKGVIVHRLEAVSYNISADLEVVTSTWVLVGGVLGSQEWYTTVPRYVATNGYLISNFDESPCVFVSESAICSQNSLYPMSPLLQSADLEVVTSTWVLVGGVLQCIRGDTSSCARTLVSGTMGNKFILSKGNIVANCASILCKCYSTGTIINQSPDSADLEVVTSTWVLVGGVLKLLTFIASDTCPLVEIDGVTIQVGGRQYPDMVYESKVALGPAISLERLDVGTSADLEVVTSTWVLVGGVLNLGNALKKLDDAKVLIDSSNQILETVRRSSFNFGSLLSVPILICTALALSADLEVVTSTWVLVGGVLLLLIYCCKRRYQQTLKQNAKVDPAFKPDLTGTSKSYVRSLSADLEVVTSTWVLVGGVL

SEQ ID NO: 1062 - protein, 910 aa, Artificial Sequence
  Birch Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMGVFNYETETTSVIPAARLFKAFILDGDNLFPKVAPQAISADLEVVTSTWVLVGGVLSSVENIEGNGGPGTIKKISFPEGFPFKYVKDRVDEVDHSADLEVVTSTWVLVGGVLTNFKYNYSVIEGGPIGDTLEKISNEIKIVATPDGGSILKISSADLEVVTSTWVLVGGVLNKYHTKGDHEVKAEQVKASKEMGETLLRAVESYLLAHSDAYN

SEQ ID NO: 1063 - protein, 716 aa, Artificial Sequence
  Tetanus Toxin Fragment C
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGDKILGCDWYFVPTDEGWTND

SEQ ID NO: 1064 - protein, 736 aa, Artificial Sequence
  Rabies Virus Glycoprotein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGKFPIYTIPDKLGPWSPIDIHHLSCPNNLVVEDEGCTNLSG

SEQ ID NO: 1065 - protein, 716 aa, Artificial Sequence
  P. Falciparum (malaria)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMSKVQKDSAKPLDKFGNIYD

SEQ ID NO: 1066 - protein, 710 aa, Artificial Sequence
  Cat Major Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGFAVANGNELLLDLS

SEQ ID NO: 1067 - protein, 710 aa, Cat Major Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGVAQYKALPVVLENA

SEQ ID NO: 1068 - protein, 710 aa, Cat Major Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGDAKMTEEDKENALS

SEQ ID NO: 1069 - protein, 715 aa, Artificial Sequence
  Cat Major Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMTTISSSKDCMGEVQNTVE

SEQ ID NO: 1070 - protein, 715 aa, Artificial Sequence
  Cat Major Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGDLSLTKVNATEPERTAMKK

SEQ ID NO: 1071 - protein, 709 aa, Artificial Sequence
  HCV E2
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGQLINTNGSWHINS

SEQ ID NO: 1072 - protein, 711 aa, Artificial Sequence
  Major Peanut Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGNLREGEPDLSNNFGK

SEQ ID NO: 1073 - protein, 705 aa, Artificial Sequence
  Crustacean Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGFLAEEADRK

SEQ ID NO: 1074 - protein, 930 aa, Artificial Sequence
  Dog Dander Allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMQLLLLTVGLALICGLQAQEGNHEEPQGGLEELSGRWHSVALASSADLEVVTSTWVLVGGVLNKSDLIKPWGHFRVFIHSMSAKDGNLHGDILIPQDGQCEKVSLTASADLEVVTSTWVLVGGVLFKTATSNKFDLEYWGHNDLYLAEVDPKSYLILYMINQYNDDTSLVASADLEVVTSTWVLVGGVLHLMVRDLSRQQDFLPAFESVCEDIGLHKDQIVVLSDDDRCQGSRD

SEQ ID NO: 1075 - protein, 1046 aa, Artificial Sequence
  Johnson grass pollen (Sorghum halepense)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMSWSMQVALVVALAFLVGGAWCGPPKVAPGKNITATYGSDWLSADLEVVTSTWVLVGGVLERKATWYGKPTGAGPDDNGGACGYKDVNKAPFNSMGACGNLSADLEVVTSTWVLVGGVLPIFKDGLGCGSCFEIKCDKPAECSGEAVVVHITDMNEQIAAYHFDSADLEVVTSTWVLVGGVLLAGTAFGAMAKKGEEEKLRKAGIIDMKFRRVKCKYGEKVTFHVESADLEVVTSTWVLVGGVLKGSNPNYLALLVKYVDGDGDVVGVDIKEKGGDAYQPLKHSWGAISADLEVVTSTWVLVGGVLWRKDSDKPIKFPVTVQITTEGGTKTAYEDVIPEGWKADTTYTAK

SEQ ID NO: 1076 - protein, 1246 aa, Artificial Sequence
  latex allergen (Hevea brasiliensis) (Hev b 7)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMATGSTPLTQGKKITVLSIDGGGIRGIIPGIILASLESKLQSADLEVVTSTWVLVGGVLDLDGPDARIADYFDIIAGTSTGGLITTMLTAPNEDKKPMYSADLEVVTSTWVLVGGVLQAKDIKDFYLENCPKIFPKESRDNYDPIHSIGPIYDGEYLSADLEVVTSTWVLVGGVLRELCNNLLKDLTVKDTLTDVIIPTFDIKLLLPVIFSSDDAKCSADLEVVTSTWVLVGGVLNALKNARLADVCISTSAAPVLLPAHSFTTEDDKNIHTFELSADLEVVTSTWVLVGGVLIDGGVAATNPTLLALTHIRNEIIRQNPRFIGANLTESKSRLVLSADLEVVTSTWVLVGGVLSLGTGKSEYKEKYNADMTSKWRLYNWALYNGNSPASADLEVVTSTWVLVGGVLVDIFSNASSDMVDFHLSALFKSLDCEDYYLRIQDDTLTSADLEVVTSTWVLVGGVLGEESSGHIATEENLQRLVEIGTELLEKQESRINLDTGRSADLEVVTSTWVLVGGVLLESIPGAPTNEAAIAKFAKLLSEERKLRQLK

SEQ ID NO: 1077 - protein, 1231 aa, Artificial Sequence
  latex allergen (Hevea brasiliensis) (esterase precursor / Hev b 13)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMEFPETNNNPIITLSFLLCMLSLAYASETCDFPAIFNFGDSNSADLEVVTSTWVLVGGVLSDTGGKAAAFYPLNPPYGETFFHRSTGRYSDGRLIIDFIAESSADLEVVTSTWVLVGGVLFNLPYLSPYLSSLGSNFKHGADFATAGSTIKLPTTIIPAHGGFSADLEVVTSTWVLVGGVLSPFYLDVQYSQFRQFIPRSQFIRETGGIFAELVPEEYYFEKALSADLEVVTSTWVLVGGVLYTFDIGQNDLTEGFLNLTVEEVNATVPDLVNSFSANVKKIYDLSADLEVVTSTWVLVGGVLGARTFWIHNTGPIGCLSFILTYFPWAEKDSAGCAKAYNEVAQSADLEVVTSTWVLVGGVLHFNHKLKEIVAQLRKDLPLATFVHVDIYSVKYSLFSEPEKHGFESADLEVVTSTWVLVGGVLFPLITCCGYGGKYNFSVTAPCGDTVTADDGTKIVVGSCACPSVSADLEVVTSTWVLVGGVLRVNWDGAHYTEAANEYFFDQISTGAFSDPPVPLNMACHKTESLRTLASV

SEQ ID NO: 1078 - protein, 843 aa, Artificial Sequence
  fungal allergen (Cladosporium herbarum)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMKYMAAYLLLGLAGNSSPSAEDIKTVLSSVGIDADEESADLEVVTSTWVLVGGVLRLSSLLKELEGKDINELISSGSQKLASVPSGGSGAAPSADLEVVTSTWVLVGGVLSAGGAAAAGGATEAAPEAAKEEEKEESDDDMGFGLFD

SEQ ID NO: 1079 - protein, 910 aa, Artificial Sequence
  alder pollen allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMGVFNYEAETTSVIPAARLFKSYVLDGDKLIPKVAPQAISADLEVVTSTWVLVGGVLTSVENVEGNGGPGTIKNITFGEGSRYKYVKERVDEVDNSADLEVVTSTWVLVGGVLTNFTYSYTVIEGDVLGDKLEKVCHELKIVAAPGGGSILKISADLEVVTSTWVLVGGVLSSKFHAKGDHEINAEEMKGAKEMAEKLLRAVETYLLAHSAEYN

SEQ ID NO: 1080 - protein, 1171 aa, Artificial Sequence
  vespid venom allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGSERPKRVFNIYWNVPTFMCHQYGLYFDEVTNFNIKHSADLEVVTSTWVLVGGVLNSKDDFQGDKISIFYDPGEFPALLPLKEGNYKIRNGGSADLEVVTSTWVLVGGVLVPQEGNITIHLQRFIENLDKTYPNRNFNGIGVIDFERWSADLEVVTSTWVLVGGVLRPIFRQNWGNMMIHKKFSIDLVRNEHPFWDKKMIELESADLEVVTSTWVLVGGVLASKRFEKYARLFMEETLKLAKKTRKQADWGYYGYPYSADLEVVTSTWVLVGGVLCFNMSPNNLVPDCDATAMLENDKMSWLFNNQNVLLPSADLEVVTSTWVLVGGVLSVYIRHELTPDQRVGLVQGRVKEAVRISNNLKHSPKVLSADLEVVTSTWVLVGGVLSYWWYVYQDDTNTFLTETDVKKTFQEIAINGGDGIIIWGSADLEVVTSTWVLVGGVLSSSDVNSLSKCKRLREYLLTVLGPITVNVTETVN

SEQ ID NO: 1081 - protein, 1181 aa, Artificial Sequence
  dust mite allergen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGFVMKREPLRFRDITVEGNENAYIKNGKLHLSLMDPSADLEVVTSTWVLVGGVLSTLSLVTKADGKIDMTVDLISPVTKRASLKIDSKKYNSADLEVVTSTWVLVGGVLLFHEGELSASIVNPRLSWHQYTKRDSREYKSDVELSSADLEVVTSTWVLVGGVLLRSSDIALKITMPDYNSKIHYSRQGDQINMDIDGTLIEGSADLEVVTSTWVLVGGVLHAQGTIREGKIHIKGRQTDFEIESNYRYEDGKLIIEPVSADLEVVTSTWVLVGGVLKSENGKLEGVLSRKVPSHLTLETPRVKMNMKYDRYASADLEVVTSTWVLVGGVLPVKVFKLDYDGIHFEKHTDIEYEPGVRYKIIGNGKLKDDSADLEVVTSTWVLVGGVLGRHYSIDVQGIPRKAFNLDADLMDFKLKVSKPEDSNKASADLEVVTSTWVLVGGVLQFSYTFNEYTETEEYEFDPHRAYYVNWLSSIRKYIQNFIVEDN

SEQ ID NO: 1082 - protein, 921 aa, Artificial Sequence
  Lyme Disease agent (borrelia burgdorferi) OspF Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMNKKMKMFIVYAVFILIGACKIHTSYDEQSSGESKVKKIEFSADLEVVTSTWVLVGGVLSKFTVKIKNKDKSGNWTDLGDLVVRKEENGIDTGLNAGGSADLEVVTSTWVLVGGVLHSATFFSLEEEVVNNFVKVMTEGGSFKTSLYYGYKEEQSSADLEVVTSTWVLVGGVLVINGIQNKEIITKIEKIDGTEYITFSGDKIKNSGDKVAEYAISLEELKKNLK

SEQ ID NO: 1083 - protein, 1016 aa, Artificial Sequence
  Lyme Disease agent (borrelia burgdorferi) OspE Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMNKKMFIICAIFALIVSCKNYTTSKDLEGSVQDLESSEQNASADLEVVTSTWVLVGGVLKKTEQEIKKQVEGFLEILETKDLNTLNTKDIKEIEKQIQELKSADLEVVTSTWVLVGGVLDTINKLEAKKTSLKTYSEYEEQIKKIKEKLKDKKELEDKLKESADLEVVTSTWVLVGGVLLEESLKKKKEERKKALEDAKKKFEEFKGQVGSATGQTQGSADLEVVTSTWVLVGGVLQRAGNQGQVGQQAWKCANSLGLGVSYSSSTGTDSNELASADLEVVTSTWVLVGGVLNKVIDDSIKKIDEELKNTIENNGEVKKE

SEQ ID NO: 1084 - protein, 1293 aa, Artificial Sequence
  Lyme Disease agent (borrelia burgdorferi) S1 Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMNKIGIAFIISFLLFVNCRGKSLEEDLKSTTSNNKQNLISADLEVVTSTWVLVGGVLSNEKKSLNSKNNRLKDSRLSNFESKKNDQTLKKSKDSADLEVVTSTWVLVGGVLFKKDLQTLRNSKNLMPKDLDQSSNDFENLDNSESLQSADLEVVTSTWVLVGGVLEASSKHNIGKSRYGKALLKNDHDEIWIPHLNLEEDKNFESADLEVVTSTWVLVGGVLFFKKSLQNDENRYALGGWLLNNDEVLVKYRYSEKDVNSADLEVVTSTWVLVGGVLQFLIDIGKKRWGDLSSKMSTLVRLIGNYSDKSDREDEISSADLEVVTSTWVLVGGVLLLDMNLCQQFYLTKINAGGSSADILVALEKTIDQQISGVSKSADLEVVTSTWVLVGGVLELLELKNFSLTTKSELDWYLNWKRNLTDEEEETLQCCRVLSADLEVVTSTWVLVGGVLLGGELDFENLDDLFKRLGKEYSRLILRKLEEITLNYDVNRFLKSADLEVVTSTWVLVGGVLEMEKSRKSFKQALGSIRNKSKRVVIFKVRNSLLEIFKLYYNNSADLEVVTSTWVLVGGVLIGRNKKLYDYINRMLNSLIKEISRR

SEQ ID NO: 1085 - protein, 1043 aa, Artificial Sequence
  Lyme Disease agent (borrelia burgdorferi) OspD Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMKKLIKILLLSLFLLLSISCVHDKQELSSKSNLNNQKGYLDNEGSADLEVVTSTWVLVGGVLANSNYESKKQSILSELNQLLKQTTNSLKEAKNTTDNLNASNESADLEVVTSTWVLVGGVLANKVVEAVINAVNLISSAADQVKSATKNMHDLAQMAEIDLGKSADLEVVTSTWVLVGGVLIKNSSDKAIFASNLAKEAYSLTKAAEQNMQKLYKEQQKISESESADLEVVTSTWVLVGGVLSESDYSDSAEIKQAKEAVEIAWKATVEAKDKLIDVENTVKETLSADLEVVTSTWVLVGGVLDKIKTETTNNTKLADIKEAAELVLQIAKNAKEIVQQVVALLNT

SEQ ID NO: 1086 - protein, 924 aa, Artificial Sequence
  Lyme Disease agent (borrelia burgdorferi) EppA Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMRKISLLLFLLFMLSIDLSAFMSQDIKKNYEKAKKAFSKEDYDLSADLEVVTSTWVLVGGVLLNKRLDNYDFESEYDKSFFFAKAPEIRGSLRKIGIKENSVLLDASADLEVVTSTWVLVGGVLLDVVGFIKSKITTDFLSFIIMNINSLIKGYPNSIFDYLIQLDSDKIDSADLEVVTSTWVLVGGVLYAEKYGEKARENFEESYKKDKITAVKQILKQILADLPKD

SEQ ID NO: 1087 - protein, 1538 aa, Artificial Sequence
  Rinderpest Virus - Hemaggluttiin
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMSSPRDRVNAFYKDNLQFKNTRVVLNKEQLLIERPYMLLAVLFVMSADLEVVTSTWVLVGGVLFLSLVGLLTIAGIRLHRAAVNTAEINSGLTTSIDVTKSIEYQVKDSADLEVVTSTWVLVGGVLVLTPLFKIIGDEVGLRTPQRFTDLTKFISDKIKFLNPDKEYHFRDSADLEVVTSTWVLVGGVLINWCINPPERIKINYDQYCAHTAAEDLITMLVNSSLAGPPVLRTSSADLEVVTSTWVLVGGVLSVKLRRNCTGPTTTKGQFSNMSLTLSGIYSGRGYNISSMITITEESADLEVVTSTWVLVGGVLMYGSTYLVGKYSQRARKSSTGWQQDYRVFEVGIIRELGVGTSADLEVVTSTWVLVGGVLPVFHMTNYLELPRQPELETCMLALGESKLAALCLADSPIALHYGSADLEVVTSTWVLVGGVLGAGDDNRIKFIKLGVWASPADLDTLAILSAIDPKLDGLYITTHRGIISADLEVVTSTWVLVGGVLVAGKAIWAVPVTRTDDQLRMGKCRLEACRDKPPPFCNSTDWEPSADLEVVTSTWVLVGGVLLEAGRIPAYGVLTIRLGLADKPEIDIISEFGPLITHDSGMDLYTSSDSADLEVVTSTWVLVGGVLGNEYWLTIPPLQNSALGTVNTLVLEPRLKISPNILTLPIKSGGGDCSADLEVVTSTWVLVGGVLYTPTYLSDRSDDDVKLSSNLVILPSRNLQYVSATYDISRIEHAIVYSADLEVVTSTWVLVGGVLYIYSTGRLSSYYYPFKLPIKGDPVSLQIECFPWTRKLWCHHFCTVSADLEVVTSTWVLVGGVLIDSGTGEQVTHTGVVGIEITCNRR

SEQ ID NO: 1088 - protein, 850 aa, Artificial Sequence
  Blastomyces dermatitidis (WI-1 Protein)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGDPYHEKYDWDLWNKWCNKDPYNCDWDPSHEKYDWDLWNKSADLEVVTSTWVLVGGVLWCNKDPYNCDWDPYHEKYDWDLWNKWCNKDPYNCDWDPYSADLEVVTSTWVLVGGVLHEKYDWDLWNKWCNKDPYNCDWDPSHEKYDWDLWSKWCNK

SEQ ID NO: 1089 - protein, 994 aa, Artificial Sequence
  Shigella flexneri ShET1 Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMVQRNIPFILAPVIHGVRDRGTFLRNDIISCSVIFIHKCPVTSQCSADLEVVTSTWVLVGGVLDMAKMEVSVFQRQCFHCKLTVFPVFLVQADRCTATDGGMDNRMSLSADLEVVTSTWVLVGGVLEYQGATVLTQGTFRQVHATIKDYLSSPRHLWNGDIHIPGQLTMKDSADLEVVTSTWVLVGGVLNGLFCPPEQDPIFYCLNCVVFVHANKLPLSRIIQAVPPQSVTIAGSADLEVVTSTWVLVGGVLRFQNIEAGLAVEYHAVQVSWSAGTTKGGYISNRRFTDICILSLKIQ

SEQ ID NO: 1090 - protein, 1494 aa, Artificial Sequence
  Shigella flexneri ShET2 Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMPSVNLIPSRKICLQNMINKDNVSVETIQSLLHSKQLPYFSSADLEVVTSTWVLVGGVLDKRSFLLNLNCQVTDHSGRLIVCRHLASYWIAQFNKSSGHVSADLEVVTSTWVLVGGVLDYHHFAFPDEIKNYVSVSEEEKAINVPAIIYFVENGSWGDISADLEVVTSTWVLVGGVLIFYIFNEMIFHSEKSRALEISTSNHNMALGLKIKETKNGGDSADLEVVTSTWVLVGGVLFVIQLYDPNHTATHLRAEFNKFNLAKIKKLTVDNFLDEKHQSADLEVVTSTWVLVGGVLKCYGLISDGMSIFVDRHTPTSMSSIIRWPDNLLHPKVIYHASADLEVVTSTWVLVGGVLMRMGLTELIQKVTRVVQLSDLSDNTLELLLAAKNDDGLSGLSADLEVVTSTWVLVGGVLLLALQNGHSDTILAYGELLETSGLNLDKTVELLTAEGMGGRSADLEVVTSTWVLVGGVLISGLSQALQNGHAETIKTYGRLLKKRANIEYNKLKNLLTAYSADLEVVTSTWVLVGGVLYYDEVHRQIPGLMFALQNGHADAIRAYGELILSPPLLNSEDSADLEVVTSTWVLVGGVLIVNLLASRRYDNVPGLLLALNNGQADAILAYGDILNEAKLNSADLEVVTSTWVLVGGVLLDKKAELLEAKDSNGLSGLFVALHNGCVETIIAYGKILHTASADLEVVTSTWVLVGGVLDLTPHQASKLLAAEGPNGVSGLIIAFQNRNFEAIKTYMKSADLEVVTSTWVLVGGVLIIKNENITPEEIAEHLDKKNGSDFLEIMKNIKS

SEQ ID NO: 1091 - protein, 715 aa, Artificial Sequence
  Picornavirus - VP1 Capsid Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGVQTRHVVQHRSRSESSISF

SEQ ID NO: 1092 - protein, 838 aa, Artificial Sequence
  Picornavirus - Polyprotein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGSRDALPNTEASGPTHSKEIPALTAVETGATNPLVPSDSADLEVVTSTWVLVGGVLTVQTRHVVQHRSRSESSIESFFARGACVTIMTVDNPSADLEVVTSTWVLVGGVLASTTNKDKLFAVWKITYKDTVQLRRKLEFFTYS

SEQ ID NO: 1093 - protein, 727 aa, Artificial Sequence
  Foot and Mouth Disease Antigen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGYNGECRYNRNAVPNLRGDLQVLAQKVARTLP

SEQ ID NO: 1094 - protein, 855 aa, Artificial Sequence
  Cryptosporidium parvum - Surface Antigen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGKLLTMKLDEVVELLPARKRRKIARGCLNRRTAAFIAKLRKSSADLEVVTSTWVLVGGVLKAECPMGEKPVAVRTHLRNMVILPEMVGSVAGVYNGKTYVTSADLEVVTSTWVLVGGVLVEIKPEMIGMYLGEFSITYKPVRHGKPGVGSTSSSRFIPLK

SEQ ID NO: 1095 - protein, 759 aa, Artificial Sequence
  Rickettsia rickettsii - Surface Antigen
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMAQKPNFLKKLISAGLVTASTATIVASFAGSAMGAAIQQNRTTNGAATTVDGAGFDQTAAPAN

SEQ ID NO: 1096 - protein, 866 aa, Artificial Sequence
  Rotavirus - VP8 Protein
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGPTTFTPPNDYWILINSNTNGVVYESTNNSDFWTAVVAIEPHVNPSADLEVVTSTWVLVGGVLVDRQYMIFGESKQFNVSNDSNKWKFLEMFRSSSQNEFYNRRTLTSADLEVVTSTWVLVGGVLSDTRLVGILKYGGRVWTFHGETPRATTDSSSAANLNNISITIHSEF

SEQ ID NO: 1097 - protein, 708 aa, Artificial Sequence
  Tumor Rejection Antigen Precursor MAGE-1
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGEHSAYGEPRKLL

SEQ ID NO: 1098 - DNA, 1842 bp, Artificial Sequence
  EHV-1 Glycoprotein D
atgcctgcagtacttcttgtgttgtacgtaaatcctcctccatcagtctgtatacttacgcagaaactttcacttggattgtataatcagtggtggcgggtttgtagatctgtgccccctccctggtacgtgttctttagcgcggacctggaggtcgtgacatcaacctgggttctcgtagggggcgtgcttaacaagagaagcatgtctacgtttaaactgatgatggatgggagactggtgttcgccatggccatagcgatcctgtccgtggtattgtcctgtggaacttgcgaaaaagctaagcgagctgttcgagggagatcagctgacctggaggtagtcacctccacatgggttctggtgggcggcgtccttcaagacagaccaaaagagtttccccctccccgctacaactacactatcctcaccaggtataacgctaccgcactggccagtccctttataaacgaccaggtgaaaaacgtggaccttaggatagtgaccgcaacaaggccatccgcagacttggaagtcgtcacaagtacctgggtcttggtgggaggcgtgctgtgcgagatgatcgcactcatcgctaagaccaacatcgactcaattctgaaagaactcgcagctgcccagaaaacatacagcgctagacttacttggtttaagatcatgccaacttgcgcaacacctatccacgacgtgtcatactctgcagacctcgaggttgttacaagtacttgggtgctggttggcggcgttttgatgaagtgcaatccaaagctcagctttgcaatgtgtgacgagagaagtgacattctctggcaagccagcctgatcaccatggcggccgaaactgacgatgagcttgggctcgtgctcgccgcccccgcacatagcgcagacctggaggtggtcaccagcacctgggtgctggtcggcggcgtgctcagcgctagtggactgtatcggcgcgtgatcgagatagatggacgccggatctatacagatttcagtgtcacaatccccagcgaaagatgtcccattgcattcgaacagaacttcgggaacccagatagatgcaagagcgccgatcttgaagtggtcacgtcaacctgggtgttggtaggcggtgtgctgaccccagaacaatacagccggggcgaggtcttcacccgccgctttcttggggagttcaattttcctcagggagaacacatgacatggttgaaattttggttcgtgtatgatggaggcaacctgccagtaagcgccgacctggaggttgtgacgagcacatgggtgctcgtcgggggcgttctgcagttctacgaggcccaggcttttgctaggcccgtaccacccgacaaccaccccgggttcgatagtgttgagagcgagatcacccagaataaaaccgatccaaaaccagggcaagcagacccaaagccaaattctgccgacttggaggtcgttactagcacttgggtactcgttgggggagttctgcagccattcaaatggcccagtatcaagcaccttgctccccgactggatgaggtggacgaagttattgagccagtcactaaaccccctaaaacttctaagagtaattccacttttgtcgggatcagtgtcgggctgggctctgctgatttggaagtggtcacaagcacttgggtgcttgtcggaggggtgctcatcgccgggctggtcctcgtgggcgtgatcctgtacgtgtgcctccgccggaaaaaggagctgaagaaaagtgcccagaatggacttacccgacttcgctctaccttcaaggatgtgaaatatacccaacttcct

SEQ ID NO: 1099 - DNA, 2415 bp, Artificial Sequence
  Canine Distemper Virus - CDV-H
atgttgagctaccaggacaaggtcggagcattttacaaggacaatgcccgagccaacagttccaaactgtctttggtgaccgaggagcaaggcggacgacgacctccttacctgctcttcgtcctgctgatactgttggtcggaatttctgcagacctggaggtcgtcacaagtacatgggttctcgtcgggggtgttctccttgccctgcttgcaatcgcaggcgtacgcttccgacaggttagtacctctaatgttgaatttggtcgacttcttaaagatgacctggaaaagtctgaggccgtgcaccaccaggtgatggatgtactgaccccactgtttaagatcatcagtgccgatctggaagtcgtcacttccacttgggtgcttgtcggaggcgtgctcggagatgagatcggcttgaggctcccgcagaaactgaatgagatcaagcaattcattttgcaaaaaaccaacttttttaacccaaatcgggaattcgactttcgggacctgcattggtgtattaaccccccgagcaaaattaaggtgaacttttcagcagatcttgaggttgttaccagtacttgggtgctggtgggtggtgtgctcacaaactactgtgatgccattggggtgcgcaagagtatcgcaagcgccgccaatcctatattgctttccgcgctgtcaggtggacgcggcgatatatttcctccttaccggtgctctggcgcaaccacctcagttggacgggttttcccactctccgctgatctggaagtggttactagtacctgggtccttgtgggcggcgtgctgtcagtgtctctctctatgtccctcatctccaagacatcagaaatcattagcatgctgaccgccatcagcaaaggtgtgtacgggaaaacgtatcttctggtgcccgagtatatcgaaagagaattcgacacccagaagatccgagtgtttgagatcggtttttctgctgacctcgaagttgtcaccagtacctgggtgctggttggaggagtgctgatcaagcgctggctgaatgatatgcccctcctccaaaccacaaactatatggtgctccccgaaaacagcaaggcaaaggtgtgcaccatcgcggtcggggaactgactctggcctccctgtgcgtggacgaatccactgttttgctgtatcacgattcagctgatctcgaagtagttaccagcacctgggtcctcgtcggtggtgtgctgagcaacggtagccaagactctatccttgtcgtgacattgggcatcttcggagccacacccatgaatcaggttgaggaggtgatcccggtggctcacccaagcgtcgagagaatccacattacgaaccaccgggggtttattaaggactccgttgcgacatggagtgcagatttggaggtcgttacttcaacctgggtgctcgtaggaggcgtcctcatggtgccagctctggtctctgagcaacaggagggccagaagaactgtctggaaagcgcttgtcagcggaaatcatatccaatgtgcaaccaaacatcatgggaaccattcgggggagtacaactcccttcctacggaagactgactctctctgctgatctcgaggtggtgacaagcacatgggttctggtgggtggcgtcctgccactggatgcctccatcgacctccagctgaacataagttttacctacggccccgtgattcttaacggagacggaatggactactatgagaatcccctgcttgatagtggatggctcaccataccgcccaagaacggcacaattcttggcctgatcaacaaggcctctgcggacctggaagtggtgacatctacctgggttcttgtgggcggagtgttgtcaagaggcgatcagttcaccgttacccctcacgtactcacatttgctccacgagaatcatctggaaactgctatcttcccatccaaacatcccagattatggataaagatgtgctgactgagagcaacctcgtggtgctcccaacacagaacttccggtacagtgcagacctcgaagtagtaacgtcaacgtgggtcctcgtgggcggagtcctcgtggttgctacatacgacatcagtcgggaaaaccacgcaatcgtatactatgtgtatgaccctatacgcactatcagttatacatatccctttcggctcactacaaagggccggccagattttctgagaattgagtgtttcgtgtgggacgatgatctttggtgtcacagcgctgacctggaggtggtgacctctacatgggtgctggtcggaggggtgctccagttctacaggtttgagtcagacattaccaatagcaccacaagtgtggaagatctggttagaattcgattcagctgcaaccgctccaaaccc

SEQ ID NO: 1100 - DNA, 2688 bp, Artificial Sequence
  Canine Distemper Virus - CDV-F
atgcacaataagatcccaaaaaggtcaaatacaagaacccacacacagcaggatcttcctcctcagcccagcacgaagtcagccgagaccaagacttcacaggcccgccatagtatcacatctgctcggcgctccacgcaccatgatagcgcagatcttgaggttgttacttctacgtgggtgctcgtgggcggtgtgttgcctcttacatcagacaggcccatccactacatcatgaaccgcattcggtcttgcaagcaaacttcctatcggtccgacaatataccggctcatggtgaccatgagggtatcattcaccacacgcctggatccgtgccacagggatccggatcttctgcagacttggaagtggtgacctccacgtgggtccttgtaggcggggtgctccaaatcaaacgccggcagagcaacgccattaacagcggaagtcagtgcacctggcttgtcctgtggtgcattggcgtggcgtcactcttcctgtgcagcaaggctcagatccattggaacaatctgtcaacgataggcataattggcactgacagctctgccgacctggaagtagtgacatcaacctgggtcttggttggcggcgtcctcgtccactataagattatggccagaccctcccatcagtatctcgtaatcaaattgatgcccaatgttagtctcattgagaattgcacaaaagcaaaactcggcgagtacgagaaactcctgaactctgtacttgagcccataaaccaggccctgactctcagcgccgatttggaggtggtgacctcaacctgggtgcttgtcggtggcgttctgatgaccaagaatgttaagccgctgcaatctctggggtctgggagaaggcagcgaagattcgctggcgttgtgcttgcgggcgcagctcttggggtcgccaccgccgcacagatcactgcgggcatagcacttcaccaatccaatctcaatgccagcgctgacttggaggtggtcacctctacatgggttctggtgggcggggtgcttcaggcgatccagtctctgaggacctcactggaacagagcaataaggccatcgaggagatccgcgaagctacccaggagaccgtcatcgcagtgcagggtgtccaggactacgtgaacaacgaactcgtgcctgctatgcagcatatgagctgtgagagcgccgatctcgaggtggtcacttctacatgggtcctggtgggaggtgtgttgctggtggggcagaggcttgggctcaaacttttgcggtactatacagagctccttagtatcttcggcccctccctccgggaccccatcagcgctgaaatttctattcaggctttgtcctatgcgttgggtggcgagatacataagatactggagaaactcgggtactctgctgatctggaagtggtcaccagcacctgggtgttggtaggtggcgtcctgtctgggtccgatatgattgccatattggaaagtagagggatcaaaactaaaatcactcacgtggatctgcccggcaagctcatcatcctgtctattagctatcctactctgagcgaagtaaaaggggttatagtgcaccgcctggaagctgtcagctataacatttcagcagacctcgaagtggtcactagtacttgggtgttggtgggcggcgtcctgggtagtcaggagtggtacaccacggtgcccagatatgtcgccacaaatggatatctgatcagcaacttcgatgaatctccctgcgtcttcgtcagtgagtcagctatctgctcccagaatagcctgtaccctatgagcccactgctgcaaagtgccgatcttgaagtggtgacttccacctgggtcctcgtgggaggggtactccaatgcattcggggggataccagtagttgcgccaggactctggttagcggcaccatggggaataagttcatactgtccaaaggcaacatagtagccaattgcgcctcaattctctgtaaatgttattctaccgggactatcattaaccagtcaccagactctgctgatttggaagttgtgaccagcacatgggtccttgtcggcggcgttctgaaactccttactttcattgccagcgacacgtgcccattggtcgagatcgatggcgtgactatccaggttggaggaaggcagtaccccgacatggtgtacgagtccaaggtggctcttggtcccgcgatcagtctggaacgcctcgacgtgggtacttccgcagacctggaggttgtcactagcacatgggttttggttgggggagtgctgaatctcgggaatgcactgaaaaagctggatgatgctaaagtcctgattgacagctctaaccaaatactggaaaccgtgcgccggtcttcattcaattttgggtccctgctgagcgtacctattctgatttgcaccgccctcgccctcagtgccgatctggaggttgtgacctccacttgggtgctggtcggaggggtgctcctgcttctcatctattgttgcaagaggcgctaccaacagacccttaagcagaacgccaaagtagaccctgcattcaagcccgacctgacagggactagcaagagttacgtccgcagcctcagtgcggacctggaggtagtcaccagtacgtgggtcctcgtaggaggtgtcctg

SEQ ID NO: 1101 - DNA, 642 bp, Artificial Sequence
  Birch Allergen
atgggagtgtttaactatgagacggagacaaccagcgtaataccggctgcccggctgtttaaggctttcatccttgacggcgataatctcttccctaaggtggccccgcaggctatatccgccgacctggaggtggtcacatccacatgggtccttgtcggaggcgtcttgagctctgtggagaatatcgaggggaacggtgggcctggcacaatcaagaaaatctcctttcccgaggggttccccttcaagtatgttaaagacagggttgacgaagtggaccactcagctgatctggaggttgtgacaagcacatgggtgctcgttgggggagtgctgactaactttaagtataattacagtgtgatcgagggggggccaattggagataccctggaaaagatctctaatgagattaagattgttgcaaccccagatggcggtagtatcctgaaaatctcttccgccgatctggaagtcgtgaccagcacatgggtactggtgggaggtgtcctcaataagtatcacacaaaaggcgatcacgaagttaaagcagagcaggtgaaggcctccaaggaaatgggcgagacactgctccgggctgtagaaagctacttgctcgcccactccgatgcatataat

SEQ ID NO: 1102 - DNA, 702 bp, Artificial Sequence
  Dog Dander Allergen
atgcaacttttgctcctgaccgtaggactggctttgatttgcggtctgcaagcacaagagggtaatcacgaggaaccccaaggtgggttggaggaactgtcaggcaggtggcactccgtggcactggcctcctccgctgacctggaggtggtgacctccacatgggtgctggtgggcggagtcctgaataagagtgacttgatcaagccatggggccatttccgcgtgtttatccattctatgagtgcaaaagacggaaacctccatggcgatatcctgattcctcaggatggtcaatgtgagaaagtgtctcttaccgcgagcgcagatctggaagtggtaacctctacttgggtgctggtcggcggtgtgctgtttaagacagcgactagtaataagttcgatctggaatattggggtcataatgacctttacttggccgaggtggatccaaaaagttaccttattctgtatatgattaaccagtacaatgatgatacatcccttgtagcatctgctgacctggaagtcgtaactagcacctgggtgttggttgggggagtgctccacctcatggtccgcgatttgtcaaggcagcaggattttctgccggccttcgaatcagtgtgcgaagatataggattgcataaggatcagatagtggtcctgtctgatgatgataggtgtcagggctcacgggac

SEQ ID NO: 1103 - DNA, 1050 bp, Artificial Sequence
  Johnson grass pollen (Sorghum halepense)
atgagttggtctatgcaggttgcactggttgtggccctcgcctttttggtcggtggagcttggtgcggacccccaaaggtggctcctggaaagaacataaccgcaacttacggtagtgattggctttcagcagacctcgaagttgttacgtccacttgggtcctggtcggcggggttctcgagaggaaggccacatggtatggcaagcccaccggagccggacccgacgacaatggaggagcctgcgggtacaaagacgtaaacaaggccccttttaatagcatgggagcatgcggcaacctgtccgctgatctggaggttgttacttccacctgggtgcttgtcgggggtgtccttcctatattcaaagatggactcggttgcggttcttgctttgaaatcaagtgtgacaagcctgccgagtgctcaggagaagcagtcgttgttcacataacggatatgaacgaacagatagctgcctaccattttgactcagccgatctggaagtggtcacttctacctgggtcttggtggggggggttctgctcgctggcaccgctttcggtgccatggctaagaaaggcgaagaggagaaactgaggaaagccgggatcatcgacatgaagttccggagagtgaaatgtaagtatggggagaaggtgacgtttcacgtggaaagtgccgatctggaggtcgtgactagtacctgggtgttggtgggaggcgtgctgaaaggtagcaatcctaactatttggccctgctggtgaagtacgttgacggcgatggcgacgtagtgggggtggacattaaagagaaaggcggcgatgcctatcagccgttgaagcactcctggggcgccatatcagccgacctcgaagtggtgacatccacttgggttctcgtgggaggagtactgtggcggaaggactctgataaacctataaaattccctgtgaccgtgcagatcactacagagggcgggaccaaaaccgcatacgaagatgttatccctgaaggatggaaggccgacaccacctataccgccaag

SEQ ID NO: 1104 - DNA, 1650 bp, Artificial Sequence
  latex allergen (Hevea brasiliensis) (Hev b 7)
atggccacagggtctactcctttgacgcagggtaagaaaataactgtgttgtccattgacgggggaggcattcggggcatcatcccagggattatacttgcatctctggaatctaagcttcagtccgctgacctggaagtggtgacttctacctgggttcttgtgggtggggtgcttgacctggacggacctgacgcgagaatcgccgactacttcgatattatagcaggtactagcactggtgggctgattaccacaatgctgactgccccaaacgaggacaaaaagcctatgtattcagctgacctggaggtcgtcacgagtacctgggtgctcgttggtggagtcctgcaggcgaaagatatcaaggacttttacttggaaaactgcccaaaaattttccccaaggagagtcgcgataactacgaccctatacactctattggcccgatctatgacggggagtacctgagtgcagatctggaagtggttacaagcacctgggttctcgttgggggcgtgctgcgcgagctttgtaacaatctgctcaaggatctcaccgttaaagatactctgacagatgtgattattcccaccttcgatattaaacttctgctgcccgttatcttctcttctgacgacgccaaatgtagcgcagatctcgaagtcgtcacatccacctgggtactggtgggaggcgtgcttaacgccctgaaaaacgcccgccttgctgacgtttgtataagcacatctgctgctcctgtccttcttcccgcccactcttttacgacagaagatgacaaaaatatccacacattcgaacttagtgccgacctggaagttgtgacaagcacttgggtgttggtcggtggtgtcctcattgacggtggggtagccgcaacaaacccaaccctgctcgctctgacccacataagaaacgagataattcgccagaaccccagattcatcggtgccaacctcaccgaatccaaaagcaggctggtgctgtcagccgatctcgaagtagtgacaagtacttgggtcctcgtgggcggagtcctgtctctgggtacaggcaagtccgaatacaaagagaagtataatgccgacatgacctcaaagtggaggctgtataattgggctctgtacaatggcaatagccctgcttccgctgaccttgaagtggttacgtcaacttgggtgctggtgggcggcgtcctggtggacatcttctcaaatgcgagcagcgacatggtagacttccacctgtccgcccttttcaaaagtctggattgcgaagactactatctgcggatccaggatgataccttgaccagtgctgacctcgaagtcgtaacaagcacatgggtccttgtgggaggggtccttggggaagagagcagcggccatatcgcaacggaagaaaacctgcagcggctggttgagatcggcacggagctgctggaaaaacaggaatcacgcattaatctcgatacgggacggtccgccgacctggaggtggtgacgtcaacctgggtgcttgtagggggtgtcctcctggaaagcatcccaggcgctccaaccaacgaagcagctatcgccaagtttgctaaactcctgtccgaggagaggaaactgagacagctgaag

SEQ ID NO: 1105 - DNA, 1605 bp, Artificial Sequence
  latex allergen (Hevea brasiliensis) (esterase precursor / Hev b 13)
atggagtttcccgagaccaataacaatcctataattaccctgtcctttctgctgtgtatgctgtcactcgcctatgcctctgagacatgcgacttcccggctatcttcaacttcggcgacagtaactccgcagatcttgaggtcgtgacatccacgtgggtgttggtcgggggcgtacttagcgatacaggaggtaaggcggctgctttctaccccctgaatcctccttacggcgaaacatttttccaccgaagtaccgggaggtactcagacggtagactcatcatcgatttcatcgcagaatctagcgctgacctggaagtggttaccagtacatgggtgcttgtgggcggagtgttgttcaatttgccatacctgtccccttacttgagctccctggggtcaaatttcaaacacggcgctgacttcgctaccgccggatctaccatcaagttgcccacaacgattataccggctcacgggggtttctctgcggacctggaagtcgttacttccacgtgggtcctggttggtggggtcctctctcccttttacctcgatgtccagtattcccagttcagacagtttatcccacgcagccagttcatcagagaaactggtggaatcttcgccgagctcgtaccagaagagtactactttgagaaagctttgagtgccgatctcgaggttgtgacgtccacatgggtgttggtgggaggcgtattgtatacgtttgatattggtcaaaacgacctgaccgaaggattcttgaaccttaccgtggaggaagtgaacgcaactgttcccgacttggtaaactcctttagcgcaaatgtgaaaaagatctatgatctgagtgccgaccttgaggttgtgacatccacttgggttctcgttggcggcgtcctcggagctcgcaccttctggatccataacaccggtcctatcggctgcttgtcatttatcctcacgtatttcccatgggctgaaaaggatagcgcaggatgcgctaaggcttataacgaggtcgcgcagagcgccgacctggaggttgtcacttcaacttgggtgttggttggaggcgtactgcattttaatcacaaacttaaagaaatcgttgcccagctgaggaaagatcttcctctcgctacctttgtgcatgtcgacatctattctgtcaagtactccttgttcagtgagcctgagaagcacggattcgaatcagccgaccttgaagttgtgactagcacatgggtcctggtgggcggagtcttgttccccttgatcacgtgttgcggatacggaggtaagtataatttctctgtgaccgcaccctgcggtgacaccgtcacagcggatgacggaaccaaaatcgtcgtcggaagctgtgcgtgtccaagcgtcagtgccgatcttgaagttgtcacgtctacatgggttcttgtgggcggtgtactgcgagtgaactgggacggcgcacactatactgaggctgccaatgagtactttttcgaccagatctcaaccggcgccttttcagacccacctgtgccgctgaatatggcctgtcacaagacggaaagcctgcgaactttggcctcagtg

SEQ ID NO: 1106 - DNA, 441 bp, Artificial Sequence
  fungal allergen (Cladosporium herbarum)
atgaaatatatggcagcttatcttctcttgggcttggccggaaactcatctccaagcgctgaggatattaaaactgtcctctcctccgtgggtattgacgctgatgaagagtccgctgatctggaagtcgtcaccagcacatgggttctcgtaggcggtgtgttgcgcctgtcttccctgctgaaggaactggaggggaaagacatcaatgagctgatctcctctggatcccagaaactggcatcagttccgtccggcggctcaggcgccgccccatccgctgacttggaagttgtgacaagtacctgggtgctggtgggaggggtgctgtccgcaggaggtgcggccgctgctggaggggcaactgaagccgcccccgaagccgcaaaggaagaggagaaggaggaatctgacgatgatatggggttcggactgtttgat

SEQ ID NO: 1107 - DNA, 642 bp, Artificial Sequence
  alder pollen allergen
atgggcgtgtttaactacgaagctgagactacaagtgtcattcctgcagcgcggctgtttaagagttacgtgctggacggagataagctgattcctaaggttgcacctcaagcaattagcgccgacctggaggtcgtgactagcacctgggtgctggtagggggagttctgacctccgtcgagaacgtggagggtaacggcggacctggtactataaagaatattacatttggcgagggaagtcggtataagtacgtaaaggaacgggtggacgaggtggacaatagtgccgacctcgaagtcgtgacttccacttgggtgcttgtcgggggcgtcctcaccaattttacttacagctatacagtgattgaaggagacgtgcttggagacaagctggagaaagtgtgccacgagctgaagatcgtggctgcgcccggtggcggctctatccttaagatttcagccgatctggaggtggtaaccagcacctgggttctcgttggtggagtgctgtcctccaagtttcacgccaaaggggaccacgagatcaatgccgaagagatgaaaggggcaaaggagatggccgagaagctgttgcgcgctgtggaaacatatctgctggcgcatagcgcagagtataac

SEQ ID NO: 1108 - DNA, 1425 bp, Artificial Sequence
  vespid venom allergen
agtgaaagacccaagcgcgtgtttaatatctactggaatgtccccactttcatgtgccatcagtacggactgtatttcgacgaagttaccaactttaatatcaagcacagtgccgacctcgaggtggtcacctctacttgggtgttggtaggcggagtattgaattctaaagatgatttccagggagacaagatttcaatattctacgatcccggcgagtttcccgccctgctcccactgaaggaggggaactacaagatccgaaatggtggcagcgcagatctggaggtggtaacaagtacatgggtgctcgtcgggggcgtgctggtgccgcaggaaggcaacatcaccatccatctgcagagattcattgaaaatctggataagacttaccccaaccgaaacttcaatggaattggagtgattgactttgagagatggtctgccgaccttgaggttgtgacatccacatgggttttggtgggtggggtactccgacctatctttcggcagaattggggcaacatgatgatccataagaaattcagcattgacctcgtgagaaacgagcatcctttttgggacaaaaagatgattgaactggagagcgcggacttggaagtcgtgaccagtacatgggttctggtcggaggggtgttggccagtaagcgcttcgaaaaatatgccaggctcttcatggaagagacattgaaactcgctaagaagactcgcaagcaagccgactgggggtattatgggtacccctacagcgccgacttggaggtcgttacctctacctgggtccttgtgggcggtgtgctctgtttcaatatgtcaccgaacaatctggtccccgactgtgacgctactgcaatgctcgaaaatgataagatgagctggctcttcaataatcagaatgtgctgctgccgtcagcagacctggaagttgtcactagcacctgggtactggtgggtggcgttctgtccgtctacattaggcacgaactgacacctgatcaacgggtcggactggtgcagggacgagtcaaagaggccgtgcgaatctctaacaatctcaagcattccccgaaggttctgagcgccgaccttgaagtggtcacgagcacctgggtgcttgtcggaggcgtgctctcttactggtggtacgtttaccaagatgacactaatacatttctgacagagactgatgttaaaaagacatttcaggagatcgctatcaacggcggcgatggtattatcatctggggaagcgctgacctggaggtcgtcacatctacctgggttctggtgggcggtgtacttagtagcagcgatgtgaattccttgtcaaagtgtaaacggctgagggagtacctgcttacagtactgggacctatcactgtgaatgttaccgagaccgtaaac

SEQ ID NO: 1109 - DNA, 1455 bp, Artificial Sequence
  dust mite allergen
tttgtcatgaaacgcgagcctctgagatttcgagatatcacagtcgagggaaacgagaacgcgtatatcaaaaacggtaaactgcatctctctctgatggaccccagtgccgacctggaggtggtcacatctacatgggttcttgtgggaggagtgctgagcacactctcactggtgaccaaggccgacggcaaaatcgacatgactgtggatctcattagcccagttaccaaaagagctagcctgaagatcgatagcaaaaagtacaatagcgcggatctggaggtcgttacaagcacttgggttctggtgggcggggtcctccttttccatgagggagagctttctgcctctatagtgaacccgcgattgagctggcaccagtacactaagcgagactctagggaatacaagtcagatgtggagctctcatccgccgatctggaggtggtgacgagtacttgggtgttggtgggcggcgtgctcctgcgcagcagtgacatcgcactgaagatcactatgcccgactacaactctaaaatccactactctcggcagggggaccagattaacatggacatcgacggaacattgatcgagggttcagccgatctggaagtggtaactagcacatgggtattggttggaggcgtgctccatgcacaggggacaattagagaggggaaaatccacattaaaggacgacagaccgacttcgagatcgagtccaattatcgatatgaagacggcaagctcattatagaaccagtcagcgccgacttggaagtggtcacatccacatgggtgctcgtgggcggggttttgaagtccgagaacggcaaactcgagggagttctctctcggaaagtcccttctcatctcacgttggaaactcccagggtgaagatgaatatgaaatatgaccgatatgcaagtgccgatttggaggtcgtgaccagcacttgggtcctcgtcggtggtgtgcttcctgtgaaggtattcaagctcgattacgacggcattcatttcgaaaagcacacagatatcgaatacgagcccggcgtcaggtataaaattattgggaacggaaagctcaaggatgactccgccgacctcgaagtagtgacctccacttgggttttggtgggaggggttctgggccggcactattccatcgatgtgcagggcatcccacgcaaagctttcaatttggacgctgacctgatggatttcaaattgaaggtgagcaagcctgaagacagtaataaggcttcagccgacttggaggttgtgactagtacctgggtgctggtcgggggagtcttgcaattctcttacaccttcaatgaatacaccgagacagaagagtatgagtttgatccccaccgagcatattatgtcaattggctgagtagtatcagaaaatacatacagaatttcattgtcgaggacaat

SEQ ID NO: 1110 - DNA, 675 bp, Artificial Sequence
  Lyme Disease agent (borrelia burgdorferi) OspF Protein
atgaacaaaaagatgaaaatgtttattgtatatgcagtgtttatcctcatcggggcttgtaagatccatacaagttacgatgaacaatcttctggagaatccaaggtgaagaaaatcgagttctcagcagatctcgaggttgtgaccagcacatgggtcttggtgggaggagttctgagtaagtttactgttaagataaagaacaaggataagagcgggaactggactgatctgggtgaccttgtggtacgcaaagaggaaaacgggatcgacacaggcctcaacgccggaggcagcgccgaccttgaggtggtcacctcaacgtgggtattggtgggcggcgttcttcacagcgccacttttttctccctggaggaagaggtggtcaacaattttgtgaaggtgatgacagaagggggcagctttaagacttctctgtattacggatataaagaggaacagtctagtgcagacctggaagtagtcacctctacctgggtgttggtgggaggggtgctggttatcaacggcatacagaacaaggaaattatcaccaagatcgagaagatagacggcacagagtacataacctttagtggggataaaatcaaaaactcaggggacaaagtggctgagtatgccatcagcttggaggagctcaagaaaaatctgaaa

SEQ ID NO: 1111 - DNA, 960 bp, Artificial Sequence
  Lyme Disease agent (borrelia burgdorferi) OspE Protein
atgaataaaaagatgttcattatctgcgccatatttgccctgattgttagttgcaaaaactacaccacaagcaaggatctggagggatccgtgcaggacctcgaaagcagcgaacagaatgcatcagccgacttggaggtggtcacgagcacttgggtgctggttggaggagtcctcaagaagacggagcaggagatcaaaaagcaggtagaagggttcctcgaaattttggaaacaaaggatctgaatactttgaatactaaggacatcaaggaaatcgagaaacagatccaggaattgaagagcgcagatcttgaagtggtaacctcaacctgggtgctggttgggggtgtactcgacaccattaataagttggaggcaaagaagacatccctgaaaacttacagtgagtatgaagaacagattaagaagatcaaggagaagcttaaggataaaaaggagctggaggacaaactcaaagagagtgctgatctggaagtggtgacatcaacatgggtgctcgtgggcggcgtgctccttgaagaatccctgaagaagaaaaaggaggaaaggaaaaaggctctggaggacgctaagaaaaagtttgaagagtttaaaggccaagttgggagcgcaaccgggcagacccagggctccgccgacctggaggtggtgacttctacatgggttctggtgggaggcgtactccagcgggcaggtaaccaaggtcaagtgggccaacaggcatggaaatgcgccaatagcttgggactcggcgtcagttactccagcagcaccggcactgactcaaacgaactggcatccgctgaccttgaagtcgttacaagtacctgggtcttggtcggcggggtcctgaataaggtgatcgacgacagcatcaagaagatcgacgaagaacttaagaacaccattgagaataatggtgaagtgaagaaggag

SEQ ID NO: 1112 - DNA, 1791 bp, Artificial Sequence
  Lyme Disease agent (borrelia burgdorferi) S1 Protein
atgaacaagatcggcatcgccttcattattagctttctgctgttcgttaattgccgggggaaatctctggaggaggatctcaagagtactacatctaacaacaagcagaatcttatttctgctgatctggaggtagtgactagtacctgggtcctggtaggaggggtgttgtccaatgagaagaaatccttgaatagcaaaaacaacagactgaaggactcacggctctctaattttgagtccaagaagaacgaccagactctcaagaagagtaaagacagtgctgaccttgaagtggtgacatcaacctgggtgctcgtcgggggtgttctctttaaaaaggacctccagacactgcggaacagcaaaaacctcatgcccaaagacctcgatcagagttccaacgacttcgagaatctggacaactctgagtctttgcaatcagccgacttggaggtggtaaccagcacatgggtccttgtaggtggcgtcctcgaggccagcagcaagcataacattggaaagagtagatacggtaaagctctgctcaaaaatgatcatgacgagatatggattccccatctgaacctcgaggaggataagaactttgagtctgcagatctcgaggtcgtgacaagcacctgggtactcgtcggtggggtgttgttcttcaaaaagagcctgcagaatgacgagaacaggtatgctcttggcggctggctgctgaataatgacgaagttctcgtgaagtacaggtattcagaaaaagatgtgaattcagctgatctggaagtcgttacttcaacgtgggtcctggtgggcggtgtgctgcagtttctgatcgatatcggcaagaaaagatggggcgatctctcctccaaaatgagtacccttgtaaggcttatcggtaactacagcgataagagcgacagagaggatgaaatttcttcagccgaccttgaggtggtaacaagcacttgggtcctcgtcggaggagtcctgctcctggacatgaatttgtgtcagcagttttaccttacaaaaataaatgccgggggttcatccgctgacatccttgttgcgctggaaaagactatcgatcagcagatttccggtgtgagtaagagtgcggacctggaagtggtgaccagcacttgggtgctggtgggtggtgtgctcgagcttcttgagttgaagaattttagtcttactaccaaatccgagctggattggtatcttaactggaaaagaaatctcacggacgaggaggaggagacgcttcagtgttgtagggtccttagcgcagacctggaagtcgtcaccagtacttgggtgttggtcggtggagtcctgctcgggggcgagctcgacttcgaaaacctggatgacctgtttaaaaggctgggaaaagagtattctcgactcatactcagaaagctggaggaaatcactctcaactatgatgtcaacagatttctcaaatctgcggacctcgaggtagtcactagcacatgggttctggtcggtggggtcctcgagatggagaaatctcgaaagtctttcaagcaggcgctcggttccattcgcaataaatccaagagagttgtgatttttaaggttcggaatagtcttcttgaaattttcaagctgtactacaataatagtgctgacctggaggtggtcacctccacgtgggtccttgtcggcggcgtccttattggcagaaataagaaactgtatgattatatcaatcgaatgttgaactctctgatcaaggagatcagcaggcgc

SEQ ID NO: 1113 - DNA, 1041 bp, Artificial Sequence
  Lyme Disease agent (borrelia burgdorferi) OspD Protein
atgaagaagctgataaagatactgctgctgagtctgttcctgcttctctctatcagttgcgtgcatgataagcaggagctttcatccaagtcaaacttgaataatcaaaagggatacctggacaatgaaggaagcgcggatctcgaggtcgtaacttctacttgggtgcttgtcgggggtgttctggcaaactccaactatgagtcaaagaaacagtccatcctgtcagaattgaatcaacttctcaagcaaaccaccaattcattgaaagaggctaaaaataccacggataatctgaacgcctccaacgaatcagccgacctggaagtcgtgacctccacctgggttctggtgggaggcgttctcgccaacaaggtggtggaggccgtgattaacgccgtgaacctgatttcatccgcggctgatcaggtcaagtcagctacaaagaacatgcacgacctggcccaaatggctgagatagaccttggcaagagcgcggaccttgaggtggtcaccagcacgtgggttttggtcggcggtgttctgatcaagaattcatccgataaagcaatcttcgcaagcaacctcgcaaaagaggcatattctctgacaaaagcggcggagcagaatatgcagaagctgtacaaagagcagcagaaaatttctgaaagcgagtctgccgacttggaggtcgtgacttccacgtgggtcctcgtgggcggcgtcctgagcgagtctgactatagcgatagcgccgagataaagcaggccaaagaggctgtggagatcgcttggaaggcaacagttgaggctaaagataaactgatcgacgtggaaaatacagtgaaagagacgctgtccgctgacctggaggtcgtcacctccacttgggtcctggtgggtggtgtgctggataaaatcaaaaccgaaacaacgaataatacaaaactcgctgacattaaggaagctgctgaactggtgcttcagatcgctaagaatgcgaaagaaatcgtgcagcaggtggtggccctgcttaacacc

SEQ ID NO: 1114 - DNA, 684 bp, Artificial Sequence
  Lyme Disease agent (borrelia burgdorferi) EppA Protein
atgcgcaaaatctcactcctcctgtttctgctgtttatgctgtcaatcgacctgtccgcattcatgagccaagacatcaaaaagaactatgaaaaggccaagaaggcgttttctaaagaggattatgacctgtctgccgacttggaagttgttaccagcacctgggtcttggtaggcggcgttcttttgaacaaacgcctggacaactacgactttgagtccgagtatgacaagtcttttttctttgccaaagcccctgagattcgggggagcttgaggaagattggcattaaagaaaacagtgttcttcttgacgctagcgcagatctcgaggtggtgaccagcacttgggtcctcgtgggtggagtactcttggacgtagtgggctttattaagtcaaaaattaccacggacttcctgtcctttatcatcatgaacataaactccctgataaaaggttaccctaacagcatctttgattacctcattcaactggactctgataagatagattccgcagatctggaagtcgtgacaagtacttgggtgctggtcggtggggtgctttatgcggaaaagtacggcgagaaagccagggaaaacttcgaggaatcctacaaaaaggataagattactgcagttaagcaaatcctcaaacaaattctcgcagacctccccaaggac

SEQ ID NO: 1115 - DNA, 2526 bp, Artificial Sequence
  Rinderpest Virus - Hemaggluttiin
atgtcctcacccagagacagagttaacgccttctacaaagataatctgcagttcaaaaacaccagagtggtgcttaataaagagcagctgctgattgaacgaccctacatgctgctggccgtactctttgtcatgtccgctgatctggaggtggtgacatcaacttgggtcctggtcggtggagtactgtttctgagccttgtgggactgctgacaatcgccggaattcggcttcaccgagccgctgtcaacaccgccgagataaacagtggcctcacgacctccattgatgtcacaaagtcaattgagtatcaggtgaaagacagtgccgacctggaggtcgtgactagcacatgggtgctggtgggcggagtgctcgtgcttacgcccctttttaagattattggcgatgaagttgggctcagaacaccacagcgattcaccgatctgacgaagttcatctcagataaaatcaagttcttgaaccctgacaaggagtaccacttcagggattccgctgatcttgaagtggtgacatctacttgggtcctggtaggaggtgtcctgatcaactggtgtatcaacccgcctgaaaggatcaaaatcaattacgatcagtactgcgcccatacagccgccgaagacctcatcactatgcttgtgaacagttctcttgccgggccacccgtgttgcggactagctcagccgacttggaagtggttacttccacatgggtgctcgtgggaggtgtgttgagtgtgaagctccggcgaaactgtaccggacccaccactactaagggacaattttcaaatatgtcactcacactgtcaggtatttattcaggccgcgggtacaacatctcctccatgattactattactgaagagagcgcagacctggaagtggtgacttccacctgggtccttgtgggcggcgtcctgatgtacggatccacctatctcgtgggaaaatactcccagcgcgctagaaagtcttccacgggttggcagcaggattaccgagtgttcgaggtgggaattatcagagaattgggggtgggcacgtccgccgacctggaagtagtcaccagcacctgggttctcgtcggtggagtgctgcccgtttttcatatgacaaactatctcgagctgcctaggcagccagaactcgaaacttgcatgctggcacttggggagtctaagttggctgctttgtgtttggccgattctccaattgcgttgcactacggttctgctgacctcgaggtggttaccagcacttgggtcctggttggcggcgtgcttggcgccggagacgataataggattaagttcattaaactcggcgtgtgggcttctcccgccgatcttgacacattggccatactgtctgccatcgatccaaagctggacggactttacataacaacacacaggggaattatcagtgccgacttggaagttgtgacatcaacctgggtcctggtggggggggtactggttgcaggaaaggccatttgggccgtgcctgtgacgcgaaccgacgaccagctgcgcatgggaaaatgccgcctggaagcatgtagagataaacctcctcccttttgcaacagcacagactgggagccttctgcagacctggaggtggtaacctccacttgggttctggtcggaggagtgctgctggaagccgggcgcatacccgcctatggggtcttgaccatcagactgggcctggcggataagccggaaattgatattatctcagaatttggaccgttgataacacatgacagcgggatggacctgtacaccagctcagactccgctgatctcgaagtggtgaccagtacttgggtgctggtaggaggggttttgggcaacgagtactggcttacaatacccccgctgcaaaactccgccctcggcacggtgaacactctcgtgctggaacccaggctgaagatctctcccaatatcttgactcttcccataaaaagtgggggcggtgattgcagcgcagatctggaagttgtcacttcaacttgggtactggtgggcggcgtgctgtatacccctacttacctttcagatcgatcagatgatgacgtgaagttgtcctccaatctcgtcattctgccctctagaaacctccagtatgtgagcgccacatacgatatcagcaggattgaacacgccatcgtttattccgccgatctggaagtggtcaccagcacatgggtgcttgtgggcggtgtgctttacatatacagtacaggacggctgagttcctattattacccctttaagctcccaatcaagggggacccagttagtctgcagattgaatgctttccatggacgcgcaaattgtggtgtcaccatttttgtacagtttccgccgatctcgaggtggtgacaagcacctgggtgctcgtcggtggggtgttgatcgacagtggtaccggcgaacaggtgacacacacaggtgttgtgggtattgagatcacctgcaatcggcgc

SEQ ID NO: 1116 - DNA, 462 bp, Artificial Sequence
  Blastomyces dermatitidis (WI-1 Protein)
gatccttatcatgaaaagtatgactgggacttgtggaacaaatggtgcaataaggacccatacaattgtgactgggatcctagccacgaaaagtacgactgggacctttggaacaagtccgccgatctggaagtggtgaccagtacatgggtgttggtgggaggtgtactgtggtgcaacaaggatccatacaactgcgactgggacccttaccatgagaaatatgattgggatctctggaataagtggtgtaacaaagatccatataactgtgattgggatccctattccgctgatctggaagtcgttacctccacatgggtgctggtgggcggggtccttcacgagaagtatgattgggacctctggaataaatggtgtaacaaggatccttacaattgcgattgggacccttcccatgagaagtacgattgggatttgtggtccaagtggtgtaataaa

SEQ ID NO: 1117 - DNA, 894 bp, Artificial Sequence
  Shigella flexneri ShET1 Protein
atggttcagagaaatattccttttatcctggctccagttatacacggggtgagagatagaggtaccttcctcagaaatgacataatcagttgttccgtgatcttcattcataagtgtccggtgacaagccagtgttccgcggaccttgaagtggttacgagcacctgggtgctggtcggcggagtgctcgatatggcaaaaatggaggtgagcgtcttccagagacagtgcttccattgtaagttgaccgttttcccagtgtttctggttcaggccgaccggtgcactgctacagacggcgggatggataaccggatgagcttgtccgccgacttggaggtcgttacctccacctgggtccttgtggggggggtcctcgaataccagggagctaccgtgctcacccaggggacttttcgacaggtacacgctactataaaagattacttgagctcacctcgacacctctggaacggcgatattcacatccctggacagcttacgatgaaagacagcgccgatctggaggtggtcacttcaacttgggtgctcgtgggtggcgtgttgaacggcctgttctgtccccccgagcaggaccccatattttattgtcttaactgcgttgtctttgtgcacgcaaacaagctccctctctcacgcatcatccaggccgtcccacctcagtctgtgaccattgccggctctgctgaccttgaagtcgtcacttccacttgggtcttggtgggcggggttctgcggtttcagaatattgaagctggactcgcagtggaataccatgccgttcaggtatcctggagtgcaggaaccaccaagggaggctacatcagcaatagaaggtttacagacatctgcattcttagcttgaagattcag

SEQ ID NO: 1118 - DNA, 2394 bp, Artificial Sequence
  Shigella flexneri ShET2 Protein
atgccatctgttaatctgatcccttcaagaaaaatttgtctgcaaaatatgattaacaaggataacgtaagtgtcgagacaatacagtccttgcttcacagcaaacaattgccgtatttctcttctgcggatttggaggtggtgacctcaacgtgggtgcttgtcggcggggtcctggacaagagatctttcttgctcaacctcaactgtcaggtgaccgatcattccggcaggttgattgtgtgtagacacctcgcatcttactggatagcccagttcaacaaaagttcaggccatgtgtccgccgacctcgaagtcgtcacctctacgtgggtgctcgtcgggggcgtgctggactatcatcacttcgcattcccagacgagattaaaaactacgtttcagtatcagaagaggagaaggccatcaacgttccggcaatcatttacttcgttgaaaacggctcttggggcgatataagtgctgaccttgaggtcgtaaccagcacatgggtcctggtcggtggcgtgctgatcttctatattttcaacgaaatgattttccactctgagaagagtcgagcactggagatttccacaagcaaccacaatatggcattgggcctgaagataaaggagactaaaaatggaggggatagtgctgacctggaggtggtcaccagcacgtgggtactggtgggcggcgtgctcttcgtgatccagctgtacgaccccaaccataccgccactcatctgcgcgccgaattcaataagttcaatctcgccaaaatcaagaagcttacggttgataattttctggatgagaagcatcaaagcgccgatcttgaggttgtcaccagtacttgggtgttggtgggtggggtgttgaagtgctacggacttatatcagacgggatgagtatatttgtcgacaggcatactccaacaagcatgtcatccattattaggtggcccgacaatctgctgcaccctaaggtaatctaccatgcctctgcagatctggaagtggtcacaagtacatgggttctcgtcggaggagtgttgatgcggatgggcctcacagagctgattcagaaagtgaccagagtggtccagctgtctgacctgagcgacaataccctggagttgttgttggcagccaaaaacgacgacggcctgtccggtctgtcagccgatctggaggtcgttacatcaacatgggttcttgtgggaggagttctcctcctggctctgcagaatggacactctgacaccattttggcctacggggaacttctggagacatccggacttaatctcgacaagacagttgagctgctcaccgctgagggcatggggggccggagtgccgatctcgaagtggtgacatctacgtgggttctggtgggaggagtcctcatttcagggctgtcacaggcactccaaaatggccacgccgagacaatcaagacatacggaaggctccttaagaaacgcgccaatatcgaatataacaaactgaagaacctcctgacagcatacagcgctgatttggaagtggtgacttccacatgggtgctcgtaggaggggttttgtattatgatgaagttcaccggcagataccgggcctcatgttcgccctccagaatggccacgctgatgctatacgggcctatggtgagcttattctctcacccccgcttctgaatagcgaagacagcgccgatctcgaggtggttacgtccacttgggttctggtcggaggtgtgttgattgtgaatctgctggcctctcggcggtacgacaacgtgcctggactcctcttggctcttaacaatggacaggcagacgcgattctggcatacggtgatatcctgaatgaggccaagctcaactccgcggatcttgaagttgttacttcaacctgggtgctggtggggggggtgctgcttgacaagaaggccgaactgctggaagcaaaggatagcaatgggctgtcagggttgttcgtggcacttcacaacggatgcgtggaaaccatcatcgcctatggaaagattttgcatacagccagcgcagacctcgaggtggtcacatctacctgggttctggttggtggagtgctcgacttgaccccgcaccaggctagcaagctgctcgcagctgagggaccgaatggagtaagtggtctgatcatcgcctttcagaacaggaacttcgaagcgatcaaaacttacatgaagagcgctgatctggaggtggttacctctacttgggtgctggtaggcggggttctcatcattaagaatgagaatatcacaccagaggaaatcgccgagcacctggataagaagaacggctcagattttctggagatcatgaagaacatcaaatcc

SEQ ID NO: 1119 - DNA, 426 bp, Artificial Sequence
  Picornavirus - Polyprotein
tctagggatgctctgccaaatactgaagcctcaggtccaactcatagtaaagaaatcccagccctgaccgccgtggagacaggggctacaaacccactcgttccctctgactcagccgacttggaagttgtgacgtctacctgggtactggtcgggggcgtgctgacagtacagactcgccatgttgtgcagcatcggtcccggagcgaatccagcatagagagcttctttgcacggggagcctgtgtaacgataatgaccgttgacaatcccagcgccgatcttgaagtcgtgacaagcacttgggtgttggtgggaggggtactggcaagtacaactaacaaggataagctctttgctgtttggaaaatcacctataaggacacagtccagttgcggcggaagctcgaattcttcacttacagt

SEQ ID NO: 1120 - DNA, 477 bp, Artificial Sequence
  Cryptosporidium parvum - Surface Antigen
aagttgcttaccatgaagttggatgaagttgttgagctgcttcccgctcggaagcgcaggaagattgcaaggggatgtctgaataggcggaccgccgctttcatagccaagcttaggaagtcatctgccgatctggaggttgtcacctccacatgggtgctcgtgggaggtgtgctgaaagctgagtgccctatgggcgagaagccagtcgctgttcgcacccacttgcgaaacatggtgatcctccctgaaatggtgggttctgtagccggtgtctataacgggaaaacttacgtgacctccgccgatctcgaggtggttacctccacctgggtcttggttggcggcgtcctggtcgagattaaaccagaaatgattggcatgtatctgggcgaattctccatcacctataagcctgtacggcacggcaaacccggagtgggatccaccagcagctcaaggttcattcctttgaaa

SEQ ID NO: 1121 - DNA, 510 bp, Artificial Sequence
  Rotavirus - VP8 Protein
cctacaacatttacacctccgaacgactactggatcctgattaactcaaacacgaacggcgtagtgtacgaatcaacaaacaacagcgacttctggaccgctgtcgttgccattgaaccccacgtaaatccctcagctgacttggaagtagtgacctccacctgggtcctggtagggggcgttctcgtggacaggcagtacatgatattcggagagtccaagcagttcaatgtatctaatgactctaacaagtggaaatttctcgagatgttccggagctcctcccaaaatgaattttacaaccgacgcactctgacaagtgccgaccttgaggtggtgacaagcacctgggtgcttgtgggaggagttttgagtgatacccgcttggtgggaatattgaagtacggaggccgggtttggacttttcacggggagacaccacgggcgaccacggactcctccagcgccgccaacctcaataacataagtatcactatccattccgaattc

SEQ ID NO: 1122 - protein, 614 aa, Artificial Sequence
  EHV-1 Glycoprotein D
MPAVLLVLYVNPPPSVCILTQKLSLGLYNQWWRVCRSVPPPWYVFFSADLEVVTSTWVLVGGVLNKRSMSTFKLMMDGRLVFAMAIAILSVVLSCGTCEKAKRAVRGRSADLEVVTSTWVLVGGVLQDRPKEFPPPRYNYTILTRYNATALASPFINDQVKNVDLRIVTATRPSADLEVVTSTWVLVGGVLCEMIALIAKTNIDSILKELAAAQKTYSARLTWFKIMPTCATPIHDVSYSADLEVVTSTWVLVGGVLMKCNPKLSFAMCDERSDILWQASLITMAAETDDELGLVLAAPAHSADLEVVTSTWVLVGGVLSASGLYRRVIEIDGRRIYTDFSVTIPSERCPIAFEQNFGNPDRCKSADLEVVTSTWVLVGGVLTPEQYSRGEVFTRRFLGEFNFPQGEHMTWLKFWFVYDGGNLPVSADLEVVTSTWVLVGGVLQFYEAQAFARPVPPDNHPGFDSVESEITQNKTDPKPGQADPKPNSADLEVVTSTWVLVGGVLQPFKWPSIKHLAPRLDEVDEVIEPVTKPPKTSKSNSTFVGISVGLGSADLEVVTSTWVLVGGVLIAGLVLVGVILYVCLRRKKELKKSAQNGLTRLRSTFKDVKYTQLP

SEQ ID NO: 1123 - protein, 805 aa, Artificial Sequence
  Canine Distemper Virus - CDV-H
MLSYQDKVGAFYKDNARANSSKLSLVTEEQGGRRPPYLLFVLLILLVGISADLEVVTSTWVLVGGVLLALLAIAGVRFRQVSTSNVEFGRLLKDDLEKSEAVHHQVMDVLTPLFKIISADLEVVTSTWVLVGGVLGDEIGLRLPQKLNEIKQFILQKTNFFNPNREFDFRDLHWCINPPSKIKVNFSADLEVVTSTWVLVGGVLTNYCDAIGVRKSIASAANPILLSALSGGRGDIFPPYRCSGATTSVGRVFPLSADLEVVTSTWVLVGGVLSVSLSMSLISKTSEIISMLTAISKGVYGKTYLLVPEYIEREFDTQKIRVFEIGFSADLEVVTSTWVLVGGVLIKRWLNDMPLLQTTNYMVLPENSKAKVCTIAVGELTLASLCVDESTVLLYHDSADLEVVTSTWVLVGGVLSNGSQDSILVVTLGIFGATPMNQVEEVIPVAHPSVERIHITNHRGFIKDSVATWSADLEVVTSTWVLVGGVLMVPALVSEQQEGQKNCLESACQRKSYPMCNQTSWEPFGGVQLPSYGRLTLSADLEVVTSTWVLVGGVLPLDASIDLQLNISFTYGPVILNGDGMDYYENPLLDSGWLTIPPKNGTILGLINKASADLEVVTSTWVLVGGVLSRGDQFTVTPHVLTFAPRESSGNCYLPIQTSQIMDKDVLTESNLVVLPTQNFRYSADLEVVTSTWVLVGGVLVVATYDISRENHAIVYYVYDPIRTISYTYPFRLTTKGRPDFLRIECFVWDDDLWCHSADLEVVTSTWVLVGGVLQFYRFESDITNSTTSVEDLVRIRFSCNRSKP

SEQ ID NO: 1124 - protein, 896 aa, Artificial Sequence
  Canine Distemper Virus - CDV-F
MHNKIPKRSNTRTHTQQDLPPQPSTKSAETKTSQARHSITSARRSTHHDSADLEVVTSTWVLVGGVLPLTSDRPIHYIMNRIRSCKQTSYRSDNIPAHGDHEGIIHHTPGSVPQGSGSSADLEVVTSTWVLVGGVLQIKRRQSNAINSGSQCTWLVLWCIGVASLFLCSKAQIHWNNLSTIGIIGTDSSADLEVVTSTWVLVGGVLVHYKIMARPSHQYLVIKLMPNVSLIENCTKAKLGEYEKLLNSVLEPINQALTLSADLEVVTSTWVLVGGVLMTKNVKPLQSLGSGRRQRRFAGVVLAGAALGVATAAQITAGIALHQSNLNASADLEVVTSTWVLVGGVLQAIQSLRTSLEQSNKAIEEIREATQETVIAVQGVQDYVNNELVPAMQHMSCESADLEVVTSTWVLVGGVLLVGQRLGLKLLRYYTELLSIFGPSLRDPISAEISIQALSYALGGEIHKILEKLGYSADLEVVTSTWVLVGGVLSGSDMIAILESRGIKTKITHVDLPGKLIILSISYPTLSEVKGVIVHRLEAVSYNISADLEVVTSTWVLVGGVLGSQEWYTTVPRYVATNGYLISNFDESPCVFVSESAICSQNSLYPMSPLLQSADLEVVTSTWVLVGGVLQCIRGDTSSCARTLVSGTMGNKFILSKGNIVANCASILCKCYSTGTIINQSPDSADLEVVTSTWVLVGGVLKLLTFIASDTCPLVEIDGVTIQVGGRQYPDMVYESKVALGPAISLERLDVGTSADLEVVTSTWVLVGGVLNLGNALKKLDDAKVLIDSSNQILETVRRSSFNFGSLLSVPILICTALALSADLEVVTSTWVLVGGVLLLLIYCCKRRYQQTLKQNAKVDPAFKPDLTGTSKSYVRSLSADLEVVTSTWVLVGGVL

SEQ ID NO: 1125 - protein, 214 aa, Artificial Sequence
  Birch Allergen
MGVFNYETETTSVIPAARLFKAFILDGDNLFPKVAPQAISADLEVVTSTWVLVGGVLSSVENIEGNGGPGTIKKISFPEGFPFKYVKDRVDEVDHSADLEVVTSTWVLVGGVLTNFKYNYSVIEGGPIGDTLEKISNEIKIVATPDGGSILKISSADLEVVTSTWVLVGGVLNKYHTKGDHEVKAEQVKASKEMGETLLRAVESYLLAHSDAYN

SEQ ID NO: 1126 - protein, 234 aa, Artificial Sequence
  Dog Dander Allergen
MQLLLLTVGLALICGLQAQEGNHEEPQGGLEELSGRWHSVALASSADLEVVTSTWVLVGGVLNKSDLIKPWGHFRVFIHSMSAKDGNLHGDILIPQDGQCEKVSLTASADLEVVTSTWVLVGGVLFKTATSNKFDLEYWGHNDLYLAEVDPKSYLILYMINQYNDDTSLVASADLEVVTSTWVLVGGVLHLMVRDLSRQQDFLPAFESVCEDIGLHKDQIVVLSDDDRCQGSRD

SEQ ID NO: 1127 - protein, 350 aa, Artificial Sequence
  Johnson grass pollen (Sorghum halepense)
MSWSMQVALVVALAFLVGGAWCGPPKVAPGKNITATYGSDWLSADLEVVTSTWVLVGGVLERKATWYGKPTGAGPDDNGGACGYKDVNKAPFNSMGACGNLSADLEVVTSTWVLVGGVLPIFKDGLGCGSCFEIKCDKPAECSGEAVVVHITDMNEQIAAYHFDSADLEVVTSTWVLVGGVLLAGTAFGAMAKKGEEEKLRKAGIIDMKFRRVKCKYGEKVTFHVESADLEVVTSTWVLVGGVLKGSNPNYLALLVKYVDGDGDVVGVDIKEKGGDAYQPLKHSWGAISADLEVVTSTWVLVGGVLWRKDSDKPIKFPVTVQITTEGGTKTAYEDVIPEGWKADTTYTAK

SEQ ID NO: 1128 - protein, 550 aa, Artificial Sequence
  latex allergen (Hevea brasiliensis) (Hev b 7)
MATGSTPLTQGKKITVLSIDGGGIRGIIPGIILASLESKLQSADLEVVTSTWVLVGGVLDLDGPDARIADYFDIIAGTSTGGLITTMLTAPNEDKKPMYSADLEVVTSTWVLVGGVLQAKDIKDFYLENCPKIFPKESRDNYDPIHSIGPIYDGEYLSADLEVVTSTWVLVGGVLRELCNNLLKDLTVKDTLTDVIIPTFDIKLLLPVIFSSDDAKCSADLEVVTSTWVLVGGVLNALKNARLADVCISTSAAPVLLPAHSFTTEDDKNIHTFELSADLEVVTSTWVLVGGVLIDGGVAATNPTLLALTHIRNEIIRQNPRFIGANLTESKSRLVLSADLEVVTSTWVLVGGVLSLGTGKSEYKEKYNADMTSKWRLYNWALYNGNSPASADLEVVTSTWVLVGGVLVDIFSNASSDMVDFHLSALFKSLDCEDYYLRIQDDTLTSADLEVVTSTWVLVGGVLGEESSGHIATEENLQRLVEIGTELLEKQESRINLDTGRSADLEVVTSTWVLVGGVLLESIPGAPTNEAAIAKFAKLLSEERKLRQLK

SEQ ID NO: 1129 - protein, 535 aa, Artificial Sequence
  latex allergen (Hevea brasiliensis) (esterase precursor / Hev b 13)
MEFPETNNNPIITLSFLLCMLSLAYASETCDFPAIFNFGDSNSADLEVVTSTWVLVGGVLSDTGGKAAAFYPLNPPYGETFFHRSTGRYSDGRLIIDFIAESSADLEVVTSTWVLVGGVLFNLPYLSPYLSSLGSNFKHGADFATAGSTIKLPTTIIPAHGGFSADLEVVTSTWVLVGGVLSPFYLDVQYSQFRQFIPRSQFIRETGGIFAELVPEEYYFEKALSADLEVVTSTWVLVGGVLYTFDIGQNDLTEGFLNLTVEEVNATVPDLVNSFSANVKKIYDLSADLEVVTSTWVLVGGVLGARTFWIHNTGPIGCLSFILTYFPWAEKDSAGCAKAYNEVAQSADLEVVTSTWVLVGGVLHFNHKLKEIVAQLRKDLPLATFVHVDIYSVKYSLFSEPEKHGFESADLEVVTSTWVLVGGVLFPLITCCGYGGKYNFSVTAPCGDTVTADDGTKIVVGSCACPSVSADLEVVTSTWVLVGGVLRVNWDGAHYTEAANEYFFDQISTGAFSDPPVPLNMACHKTESLRTLASV

SEQ ID NO: 1130 - protein, 147 aa, Artificial Sequence
  fungal allergen (Cladosporium herbarum)
MKYMAAYLLLGLAGNSSPSAEDIKTVLSSVGIDADEESADLEVVTSTWVLVGGVLRLSSLLKELEGKDINELISSGSQKLASVPSGGSGAAPSADLEVVTSTWVLVGGVLSAGGAAAAGGATEAAPEAAKEEEKEESDDDMGFGLFD

SEQ ID NO: 1131 - protein, 214 aa, Artificial Sequence
  alder pollen allergen
MGVFNYEAETTSVIPAARLFKSYVLDGDKLIPKVAPQAISADLEVVTSTWVLVGGVLTSVENVEGNGGPGTIKNITFGEGSRYKYVKERVDEVDNSADLEVVTSTWVLVGGVLTNFTYSYTVIEGDVLGDKLEKVCHELKIVAAPGGGSILKISADLEVVTSTWVLVGGVLSSKFHAKGDHEINAEEMKGAKEMAEKLLRAVETYLLAHSAEYN

SEQ ID NO: 1132 - protein, 475 aa, Artificial Sequence
  vespid venom allergen
SERPKRVFNIYWNVPTFMCHQYGLYFDEVTNFNIKHSADLEVVTSTWVLVGGVLNSKDDFQGDKISIFYDPGEFPALLPLKEGNYKIRNGGSADLEVVTSTWVLVGGVLVPQEGNITIHLQRFIENLDKTYPNRNFNGIGVIDFERWSADLEVVTSTWVLVGGVLRPIFRQNWGNMMIHKKFSIDLVRNEHPFWDKKMIELESADLEVVTSTWVLVGGVLASKRFEKYARLFMEETLKLAKKTRKQADWGYYGYPYSADLEVVTSTWVLVGGVLCFNMSPNNLVPDCDATAMLENDKMSWLFNNQNVLLPSADLEVVTSTWVLVGGVLSVYIRHELTPDQRVGLVQGRVKEAVRISNNLKHSPKVLSADLEVVTSTWVLVGGVLSYWWYVYQDDTNTFLTETDVKKTFQEIAINGGDGIIIWGSADLEVVTSTWVLVGGVLSSSDVNSLSKCKRLREYLLTVLGPITVNVTETVN

SEQ ID NO: 1133 - protein, 485 aa, Artificial Sequence
  dust mite allergen
FVMKREPLRFRDITVEGNENAYIKNGKLHLSLMDPSADLEVVTSTWVLVGGVLSTLSLVTKADGKIDMTVDLISPVTKRASLKIDSKKYNSADLEVVTSTWVLVGGVLLFHEGELSASIVNPRLSWHQYTKRDSREYKSDVELSSADLEVVTSTWVLVGGVLLRSSDIALKITMPDYNSKIHYSRQGDQINMDIDGTLIEGSADLEVVTSTWVLVGGVLHAQGTIREGKIHIKGRQTDFEIESNYRYEDGKLIIEPVSADLEVVTSTWVLVGGVLKSENGKLEGVLSRKVPSHLTLETPRVKMNMKYDRYASADLEVVTSTWVLVGGVLPVKVFKLDYDGIHFEKHTDIEYEPGVRYKIIGNGKLKDDSADLEVVTSTWVLVGGVLGRHYSIDVQGIPRKAFNLDADLMDFKLKVSKPEDSNKASADLEVVTSTWVLVGGVLQFSYTFNEYTETEEYEFDPHRAYYVNWLSSIRKYIQNFIVEDN

SEQ ID NO: 1134 - protein, 225 aa, Artificial Sequence
  Lyme Disease agent (borrelia burgdorferi) OspF Protein
MNKKMKMFIVYAVFILIGACKIHTSYDEQSSGESKVKKIEFSADLEVVTSTWVLVGGVLSKFTVKIKNKDKSGNWTDLGDLVVRKEENGIDTGLNAGGSADLEVVTSTWVLVGGVLHSATFFSLEEEVVNNFVKVMTEGGSFKTSLYYGYKEEQSSADLEVVTSTWVLVGGVLVINGIQNKEIITKIEKIDGTEYITFSGDKIKNSGDKVAEYAISLEELKKNLK

SEQ ID NO: 1135 - protein, 320 aa, Artificial Sequence
  Lyme Disease agent (borrelia burgdorferi) OspE Protein
MNKKMFIICAIFALIVSCKNYTTSKDLEGSVQDLESSEQNASADLEVVTSTWVLVGGVLKKTEQEIKKQVEGFLEILETKDLNTLNTKDIKEIEKQIQELKSADLEVVTSTWVLVGGVLDTINKLEAKKTSLKTYSEYEEQIKKIKEKLKDKKELEDKLKESADLEVVTSTWVLVGGVLLEESLKKKKEERKKALEDAKKKFEEFKGQVGSATGQTQGSADLEVVTSTWVLVGGVLQRAGNQGQVGQQAWKCANSLGLGVSYSSSTGTDSNELASADLEVVTSTWVLVGGVLNKVIDDSIKKIDEELKNTIENNGEVKKE

SEQ ID NO: 1136 - protein, 597 aa, Artificial Sequence
  Lyme Disease agent (borrelia burgdorferi) S1 Protein
MNKIGIAFIISFLLFVNCRGKSLEEDLKSTTSNNKQNLISADLEVVTSTWVLVGGVLSNEKKSLNSKNNRLKDSRLSNFESKKNDQTLKKSKDSADLEVVTSTWVLVGGVLFKKDLQTLRNSKNLMPKDLDQSSNDFENLDNSESLQSADLEVVTSTWVLVGGVLEASSKHNIGKSRYGKALLKNDHDEIWIPHLNLEEDKNFESADLEVVTSTWVLVGGVLFFKKSLQNDENRYALGGWLLNNDEVLVKYRYSEKDVNSADLEVVTSTWVLVGGVLQFLIDIGKKRWGDLSSKMSTLVRLIGNYSDKSDREDEISSADLEVVTSTWVLVGGVLLLDMNLCQQFYLTKINAGGSSADILVALEKTIDQQISGVSKSADLEVVTSTWVLVGGVLELLELKNFSLTTKSELDWYLNWKRNLTDEEEETLQCCRVLSADLEVVTSTWVLVGGVLLGGELDFENLDDLFKRLGKEYSRLILRKLEEITLNYDVNRFLKSADLEVVTSTWVLVGGVLEMEKSRKSFKQALGSIRNKSKRVVIFKVRNSLLEIFKLYYNNSADLEVVTSTWVLVGGVLIGRNKKLYDYINRMLNSLIKEISRR

SEQ ID NO: 1137 - protein, 347 aa, Artificial Sequence
  Lyme Disease agent (borrelia burgdorferi) OspD Protein
MKKLIKILLLSLFLLLSISCVHDKQELSSKSNLNNQKGYLDNEGSADLEVVTSTWVLVGGVLANSNYESKKQSILSELNQLLKQTTNSLKEAKNTTDNLNASNESADLEVVTSTWVLVGGVLANKVVEAVINAVNLISSAADQVKSATKNMHDLAQMAEIDLGKSADLEVVTSTWVLVGGVLIKNSSDKAIFASNLAKEAYSLTKAAEQNMQKLYKEQQKISESESADLEVVTSTWVLVGGVLSESDYSDSAEIKQAKEAVEIAWKATVEAKDKLIDVENTVKETLSADLEVVTSTWVLVGGVLDKIKTETTNNTKLADIKEAAELVLQIAKNAKEIVQQVVALLNT

SEQ ID NO: 1138 - protein, 228 aa, Artificial Sequence
  Lyme Disease agent (borrelia burgdorferi) EppA Protein
MRKISLLLFLLFMLSIDLSAFMSQDIKKNYEKAKKAFSKEDYDLSADLEVVTSTWVLVGGVLLNKRLDNYDFESEYDKSFFFAKAPEIRGSLRKIGIKENSVLLDASADLEVVTSTWVLVGGVLLDVVGFIKSKITTDFLSFIIMNINSLIKGYPNSIFDYLIQLDSDKIDSADLEVVTSTWVLVGGVLYAEKYGEKARENFEESYKKDKITAVKQILKQILADLPKD

SEQ ID NO: 1139 - protein, 842 aa, Artificial Sequence
  Rinderpest Virus - Hemaggluttiin
MSSPRDRVNAFYKDNLQFKNTRVVLNKEQLLIERPYMLLAVLFVMSADLEVVTSTWVLVGGVLFLSLVGLLTIAGIRLHRAAVNTAEINSGLTTSIDVTKSIEYQVKDSADLEVVTSTWVLVGGVLVLTPLFKIIGDEVGLRTPQRFTDLTKFISDKIKFLNPDKEYHFRDSADLEVVTSTWVLVGGVLINWCINPPERIKINYDQYCAHTAAEDLITMLVNSSLAGPPVLRTSSADLEVVTSTWVLVGGVLSVKLRRNCTGPTTTKGQFSNMSLTLSGIYSGRGYNISSMITITEESADLEVVTSTWVLVGGVLMYGSTYLVGKYSQRARKSSTGWQQDYRVFEVGIIRELGVGTSADLEVVTSTWVLVGGVLPVFHMTNYLELPRQPELETCMLALGESKLAALCLADSPIALHYGSADLEVVTSTWVLVGGVLGAGDDNRIKFIKLGVWASPADLDTLAILSAIDPKLDGLYITTHRGIISADLEVVTSTWVLVGGVLVAGKAIWAVPVTRTDDQLRMGKCRLEACRDKPPPFCNSTDWEPSADLEVVTSTWVLVGGVLLEAGRIPAYGVLTIRLGLADKPEIDIISEFGPLITHDSGMDLYTSSDSADLEVVTSTWVLVGGVLGNEYWLTIPPLQNSALGTVNTLVLEPRLKISPNILTLPIKSGGGDCSADLEVVTSTWVLVGGVLYTPTYLSDRSDDDVKLSSNLVILPSRNLQYVSATYDISRIEHAIVYSADLEVVTSTWVLVGGVLYIYSTGRLSSYYYPFKLPIKGDPVSLQIECFPWTRKLWCHHFCTVSADLEVVTSTWVLVGGVLIDSGTGEQVTHTGVVGIEITCNRR

SEQ ID NO: 1140 - protein, 154 aa, Artificial Sequence
  Blastomyces dermatitidis (WI-1 Protein)
DPYHEKYDWDLWNKWCNKDPYNCDWDPSHEKYDWDLWNKSADLEVVTSTWVLVGGVLWCNKDPYNCDWDPYHEKYDWDLWNKWCNKDPYNCDWDPYSADLEVVTSTWVLVGGVLHEKYDWDLWNKWCNKDPYNCDWDPSHEKYDWDLWSKWCNK

SEQ ID NO: 1141 - protein, 298 aa, Artificial Sequence
  Shigella flexneri ShET1 Protein
MVQRNIPFILAPVIHGVRDRGTFLRNDIISCSVIFIHKCPVTSQCSADLEVVTSTWVLVGGVLDMAKMEVSVFQRQCFHCKLTVFPVFLVQADRCTATDGGMDNRMSLSADLEVVTSTWVLVGGVLEYQGATVLTQGTFRQVHATIKDYLSSPRHLWNGDIHIPGQLTMKDSADLEVVTSTWVLVGGVLNGLFCPPEQDPIFYCLNCVVFVHANKLPLSRIIQAVPPQSVTIAGSADLEVVTSTWVLVGGVLRFQNIEAGLAVEYHAVQVSWSAGTTKGGYISNRRFTDICILSLKIQ

SEQ ID NO: 1142 - protein, 798 aa, Artificial Sequence
  Shigella flexneri ShET2 Protein
MPSVNLIPSRKICLQNMINKDNVSVETIQSLLHSKQLPYFSSADLEVVTSTWVLVGGVLDKRSFLLNLNCQVTDHSGRLIVCRHLASYWIAQFNKSSGHVSADLEVVTSTWVLVGGVLDYHHFAFPDEIKNYVSVSEEEKAINVPAIIYFVENGSWGDISADLEVVTSTWVLVGGVLIFYIFNEMIFHSEKSRALEISTSNHNMALGLKIKETKNGGDSADLEVVTSTWVLVGGVLFVIQLYDPNHTATHLRAEFNKFNLAKIKKLTVDNFLDEKHQSADLEVVTSTWVLVGGVLKCYGLISDGMSIFVDRHTPTSMSSIIRWPDNLLHPKVIYHASADLEVVTSTWVLVGGVLMRMGLTELIQKVTRVVQLSDLSDNTLELLLAAKNDDGLSGLSADLEVVTSTWVLVGGVLLLALQNGHSDTILAYGELLETSGLNLDKTVELLTAEGMGGRSADLEVVTSTWVLVGGVLISGLSQALQNGHAETIKTYGRLLKKRANIEYNKLKNLLTAYSADLEVVTSTWVLVGGVLYYDEVHRQIPGLMFALQNGHADAIRAYGELILSPPLLNSEDSADLEVVTSTWVLVGGVLIVNLLASRRYDNVPGLLLALNNGQADAILAYGDILNEAKLNSADLEVVTSTWVLVGGVLLDKKAELLEAKDSNGLSGLFVALHNGCVETIIAYGKILHTASADLEVVTSTWVLVGGVLDLTPHQASKLLAAEGPNGVSGLIIAFQNRNFEAIKTYMKSADLEVVTSTWVLVGGVLIIKNENITPEEIAEHLDKKNGSDFLEIMKNIKS

SEQ ID NO: 1143 - protein, 142 aa, Artificial Sequence
  Picornavirus - Polyprotein
SRDALPNTEASGPTHSKEIPALTAVETGATNPLVPSDSADLEVVTSTWVLVGGVLTVQTRHVVQHRSRSESSIESFFARGACVTIMTVDNPSADLEVVTSTWVLVGGVLASTTNKDKLFAVWKITYKDTVQLRRKLEFFTYS

SEQ ID NO: 1144 - protein, 159 aa, Artificial Sequence
  Cryptosporidium parvum - Surface Antigen
KLLTMKLDEVVELLPARKRRKIARGCLNRRTAAFIAKLRKSSADLEVVTSTWVLVGGVLKAECPMGEKPVAVRTHLRNMVILPEMVGSVAGVYNGKTYVTSADLEVVTSTWVLVGGVLVEIKPEMIGMYLGEFSITYKPVRHGKPGVGSTSSSRFIPLK

SEQ ID NO: 1145 - protein, 170 aa, Artificial Sequence
  Rotavirus - VP8 Protein
PTTFTPPNDYWILINSNTNGVVYESTNNSDFWTAVVAIEPHVNPSADLEVVTSTWVLVGGVLVDRQYMIFGESKQFNVSNDSNKWKFLEMFRSSSQNEFYNRRTLTSADLEVVTSTWVLVGGVLSDTRLVGILKYGGRVWTFHGETPRATTDSSSAANLNNISITIHSEF

SEQ ID NO: 1146 - protein, 160 aa, Artificial Sequence; identical to SEQ ID NO: 1022
  Birch Allergen

SEQ ID NO: 1147 - protein, 20 aa, Artificial Sequence
  Tetanus Toxin Fragment C
DKILGCDWYFVPTDEGWTND

SEQ ID NO: 1148 - protein, 13 aa, Artificial Sequence
  HCV E2
QLINTNGSWHINS

SEQ ID NO: 1149 - protein, 9 aa, Artificial Sequence
  Crustacean Allergen
FLAEEADRK

SEQ ID NO: 1150 - protein, 180 aa, Artificial Sequence
  Dog Dander Allergen
MQLLLLTVGLALICGLQAQEGNHEEPQGGLEELSGRWHSVALASNKSDLIKPWGHFRVFIHSMSAKDGNLHGDILIPQDGQCEKVSLTAFKTATSNKFDLEYWGHNDLYLAEVDPKSYLILYMINQYNDDTSLVAHLMVRDLSRQQDFLPAFESVCEDIGLHKDQIVVLSDDDRCQGSRD

SEQ ID NO: 1151 - protein, 260 aa, Artificial Sequence
  Johnson grass pollen (Sorghum halepense)
MSWSMQVALVVALAFLVGGAWCGPPKVAPGKNITATYGSDWLERKATWYGKPTGAGPDDNGGACGYKDVNKAPFNSMGACGNLPIFKDGLGCGSCFEIKCDKPAECSGEAVVVHITDMNEQIAAYHFDLAGTAFGAMAKKGEEEKLRKAGIIDMKFRRVKCKYGEKVTFHVEKGSNPNYLALLVKYVDGDGDVVGVDIKEKGGDAYQPLKHSWGAIWRKDSDKPIKFPVTVQITTEGGTKTAYEDVIPEGWKADTTYTAK

SEQ ID NO: 1152 - protein, 388 aa, Artificial Sequence
  latex allergen (Hevea brasiliensis) (Hev b 7)
MATGSTPLTQGKKITVLSIDGGGIRGIIPGIILASLESKLQDLDGPDARIADYFDIIAGTSTGGLITTMLTAPNEDKKPMYQAKDIKDFYLENCPKIFPKESRDNYDPIHSIGPIYDGEYLRELCNNLLKDLTVKDTLTDVIIPTFDIKLLLPVIFSSDDAKCNALKNARLADVCISTSAAPVLLPAHSFTTEDDKNIHTFELIDGGVAATNPTLLALTHIRNEIIRQNPRFIGANLTESKSRLVLSLGTGKSEYKEKYNADMTSKWRLYNWALYNGNSPAVDIFSNASSDMVDFHLSALFKSLDCEDYYLRIQDDTLTGEESSGHIATEENLQRLVEIGTELLEKQESRINLDTGRLESIPGAPTNEAAIAKFAKLLSEERKLRQLK

SEQ ID NO: 1153 - protein, 391 aa, Artificial Sequence
  latex allergen (Hevea brasiliensis) (esterase precursor / Hev b 13)
MEFPETNNNPIITLSFLLCMLSLAYASETCDFPAIFNFGDSNSDTGGKAAAFYPLNPPYGETFFHRSTGRYSDGRLIIDFIAESFNLPYLSPYLSSLGSNFKHGADFATAGSTIKLPTTIIPAHGGFSPFYLDVQYSQFRQFIPRSQFIRETGGIFAELVPEEYYFEKALYTFDIGQNDLTEGFLNLTVEEVNATVPDLVNSFSANVKKIYDLGARTFWIHNTGPIGCLSFILTYFPWAEKDSAGCAKAYNEVAQHFNHKLKEIVAQLRKDLPLATFVHVDIYSVKYSLFSEPEKHGFEFPLITCCGYGGKYNFSVTAPCGDTVTADDGTKIVVGSCACPSVRVNWDGAHYTEAANEYFFDQISTGAFSDPPVPLNMACHKTESLRTLASV

SEQ ID NO: 1154 - protein, 111 aa, Artificial Sequence
  fungal allergen (Cladosporium herbarum)
MKYMAAYLLLGLAGNSSPSAEDIKTVLSSVGIDADEERLSSLLKELEGKDINELISSGSQKLASVPSGGSGAAPSAGGAAAAGGATEAAPEAAKEEEKEESDDDMGFGLFD

SEQ ID NO: 1155 - protein, 160 aa, Artificial Sequence
  alder pollen allergen
MGVFNYEAETTSVIPAARLFKSYVLDGDKLIPKVAPQAITSVENVEGNGGPGTIKNITFGEGSRYKYVKERVDEVDNTNFTYSYTVIEGDVLGDKLEKVCHELKIVAAPGGGSILKISSKFHAKGDHEINAEEMKGAKEMAEKLLRAVETYLLAHSAEYN

SEQ ID NO: 1156 - protein, 331 aa, Artificial Sequence
  vespid venom allergen
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 1157 - protein, 341 aa, Artificial Sequence
  dust mite allergen
FVMKREPLRFRDITVEGNENAYIKNGKLHLSLMDPSTLSLVTKADGKIDMTVDLISPVTKRASLKIDSKKYNLFHEGELSASIVNPRLSWHQYTKRDSREYKSDVELSLRSSDIALKITMPDYNSKIHYSRQGDQINMDIDGTLIEGHAQGTIREGKIHIKGRQTDFEIESNYRYEDGKLIIEPVKSENGKLEGVLSRKVPSHLTLETPRVKMNMKYDRYAPVKVFKLDYDGIHFEKHTDIEYEPGVRYKIIGNGKLKDDGRHYSIDVQGIPRKAFNLDADLMDFKLKVSKPEDSNKAQFSYTFNEYTETEEYEFDPHRAYYVNWLSSIRKYIQNFIVEDN

SEQ ID NO: 1158 - protein, 171 aa, Artificial Sequence
  Lyme Disease agent (borrelia burgdorferi) OspF Protein
MNKKMKMFIVYAVFILIGACKIHTSYDEQSSGESKVKKIEFSKFTVKIKNKDKSGNWTDLGDLVVRKEENGIDTGLNAGGHSATFFSLEEEVVNNFVKVMTEGGSFKTSLYYGYKEEQSVINGIQNKEIITKIEKIDGTEYITFSGDKIKNSGDKVAEYAISLEELKKNLK

SEQ ID NO: 1159 - protein, 230 aa, Artificial Sequence
  Lyme Disease agent (borrelia burgdorferi) OspE Protein
MNKKMFIICAIFALIVSCKNYTTSKDLEGSVQDLESSEQNAKKTEQEIKKQVEGFLEILETKDLNTLNTKDIKEIEKQIQELKDTINKLEAKKTSLKTYSEYEEQIKKIKEKLKDKKELEDKLKELEESLKKKKEERKKALEDAKKKFEEFKGQVGSATGQTQGQRAGNQGQVGQQAWKCANSLGLGVSYSSSTGTDSNELANKVIDDSIKKIDEELKNTIENNGEVKKE

SEQ ID NO: 1160 - protein, 417 aa, Artificial Sequence
  Lyme Disease agent (borrelia burgdorferi) S1 Protein
MNKIGIAFIISFLLFVNCRGKSLEEDLKSTTSNNKQNLISNEKKSLNSKNNRLKDSRLSNFESKKNDQTLKKSKDFKKDLQTLRNSKNLMPKDLDQSSNDFENLDNSESLQEASSKHNIGKSRYGKALLKNDHDEIWIPHLNLEEDKNFEFFKKSLQNDENRYALGGWLLNNDEVLVKYRYSEKDVNQFLIDIGKKRWGDLSSKMSTLVRLIGNYSDKSDREDEISLLDMNLCQQFYLTKINAGGSSADILVALEKTIDQQISGVSKELLELKNFSLTTKSELDWYLNWKRNLTDEEEETLQCCRVLLGGELDFENLDDLFKRLGKEYSRLILRKLEEITLNYDVNRFLKEMEKSRKSFKQALGSIRNKSKRVVIFKVRNSLLEIFKLYYNNIGRNKKLYDYINRMLNSLIKEISRR

SEQ ID NO: 1161 - protein, 257 aa, Artificial Sequence
  Lyme Disease agent (borrelia burgdorferi) OspD Protein
MKKLIKILLLSLFLLLSISCVHDKQELSSKSNLNNQKGYLDNEGANSNYESKKQSILSELNQLLKQTTNSLKEAKNTTDNLNASNEANKVVEAVINAVNLISSAADQVKSATKNMHDLAQMAEIDLGKIKNSSDKAIFASNLAKEAYSLTKAAEQNMQKLYKEQQKISESESESDYSDSAEIKQAKEAVEIAWKATVEAKDKLIDVENTVKETLDKIKTETTNNTKLADIKEAAELVLQIAKNAKEIVQQVVALLNT

SEQ ID NO: 1162 - protein, 174 aa, Artificial Sequence
  Lyme Disease agent (borrelia burgdorferi) EppA Protein
MRKISLLLFLLFMLSIDLSAFMSQDIKKNYEKAKKAFSKEDYDLLNKRLDNYDFESEYDKSFFFAKAPEIRGSLRKIGIKENSVLLDALDVVGFIKSKITTDFLSFIIMNINSLIKGYPNSIFDYLIQLDSDKIDYAEKYGEKARENFEESYKKDKITAVKQILKQILADLPKD

SEQ ID NO: 1163 - protein, 609 aa, Artificial Sequence
  Rinderpest Virus - Hemaggluttiin
MSSPRDRVNAFYKDNLQFKNTRVVLNKEQLLIERPYMLLAVLFVMFLSLVGLLTIAGIRLHRAAVNTAEINSGLTTSIDVTKSIEYQVKDVLTPLFKIIGDEVGLRTPQRFTDLTKFISDKIKFLNPDKEYHFRDINWCINPPERIKINYDQYCAHTAAEDLITMLVNSSLAGPPVLRTSSVKLRRNCTGPTTTKGQFSNMSLTLSGIYSGRGYNISSMITITEEGMYGSTYLVGKYSQRARKSSTGWQQDYRVFEVGIIRELGVGTPVFHMTNYLELPRQPELETCMLALGESKLAALCLADSPIALHYGGAGDDNRIKFIKLGVWASPADLDTLAILSAIDPKLDGLYITTHRGIIVAGKAIWAVPVTRTDDQLRMGKCRLEACRDKPPPFCNSTDWEPLEAGRIPAYGVLTIRLGLADKPEIDIISEFGPLITHDSGMDLYTSSDGNEYWLTIPPLQNSALGTVNTLVLEPRLKISPNILTLPIKSGGGDCYTPTYLSDRSDDDVKLSSNLVILPSRNLQYVSATYDISRIEHAIVYYIYSTGRLSSYYYPFKLPIKGDPVSLQIECFPWTRKLWCHHFCTVIDSGTGEQVTHTGVVGIEITCNRR

SEQ ID NO: 1164 - protein, 118 aa, Artificial Sequence
  Blastomyces dermatitidis (WI-1 Protein)
DPYHEKYDWDLWNKWCNKDPYNCDWDPSHEKYDWDLWNKWCNKDPYNCDWDPYHEKYDWDLWNKWCNKDPYNCDWDPYHEKYDWDLWNKWCNKDPYNCDWDPSHEKYDWDLWSKWCNK

SEQ ID NO: 1165 - protein, 226 aa, Artificial Sequence
  Shigella flexneri ShET1 Protein
MVQRNIPFILAPVIHGVRDRGTFLRNDIISCSVIFIHKCPVTSQCDMAKMEVSVFQRQCFHCKLTVFPVFLVQADRCTATDGGMDNRMSLEYQGATVLTQGTFRQVHATIKDYLSSPRHLWNGDIHIPGQLTMKDNGLFCPPEQDPIFYCLNCVVFVHANKLPLSRIIQAVPPQSVTIAGRFQNIEAGLAVEYHAVQVSWSAGTTKGGYISNRRFTDICILSLKIQ

SEQ ID NO: 1166 - protein, 564 aa, Artificial Sequence
  Shigella flexneri ShET2 Protein
MPSVNLIPSRKICLQNMINKDNVSVETIQSLLHSKQLPYFSDKRSFLLNLNCQVTDHSGRLIVCRHLASYWIAQFNKSSGHVDYHHFAFPDEIKNYVSVSEEEKAINVPAIIYFVENGSWGDIIFYIFNEMIFHSEKSRALEISTSNHNMALGLKIKETKNGGDFVIQLYDPNHTATHLRAEFNKFNLAKIKKLTVDNFLDEKHQKCYGLISDGMSIFVDRHTPTSMSSIIRWPDNLLHPKVIYHAMRMGLTELIQKVTRVVQLSDLSDNTLELLLAAKNDDGLSGLLLALQNGHSDTILAYGELLETSGLNLDKTVELLTAEGMGGRISGLSQALQNGHAETIKTYGRLLKKRANIEYNKLKNLLTAYYYDEVHRQIPGLMFALQNGHADAIRAYGELILSPPLLNSEDIVNLLASRRYDNVPGLLLALNNGQADAILAYGDILNEAKLNLDKKAELLEAKDSNGLSGLFVALHNGCVETIIAYGKILHTADLTPHQASKLLAAEGPNGVSGLIIAFQNRNFEAIKTYMKIIKNENITPEEIAEHLDKKNGSDFLEIMKNIKS

SEQ ID NO: 1167 - protein, 19 aa, Artificial Sequence
  Picornavirus - VP1 Capsid Protein
VQTRHVVQHRSRSESSISF

SEQ ID NO: 1168 - protein, 106 aa, Artificial Sequence
  Picornavirus - Polyprotein
SRDALPNTEASGPTHSKEIPALTAVETGATNPLVPSDTVQTRHVVQHRSRSESSIESFFARGACVTIMTVDNPASTTNKDKLFAVWKITYKDTVQLRRKLEFFTYS

SEQ ID NO: 1169 - protein, 31 aa, Artificial Sequence
  Foot and Mouth Disease Antigen
YNGECRYNRNAVPNLRGDLQVLAQKVARTLP

SEQ ID NO: 1170 - protein, 123 aa, Artificial Sequence
  Cryptosporidium parvum - Surface Antigen
KLLTMKLDEVVELLPARKRRKIARGCLNRRTAAFIAKLRKSKAECPMGEKPVAVRTHLRNMVILPEMVGSVAGVYNGKTYVTVEIKPEMIGMYLGEFSITYKPVRHGKPGVGSTSSSRFIPLK

SEQ ID NO: 1171 - protein, 63 aa, Artificial Sequence
  Rickettsia rickettsii - Surface Antigen
MAQKPNFLKKLISAGLVTASTATIVASFAGSAMGAAIQQNRTTNGAATTVDGAGFDQTAAPAN

SEQ ID NO: 1172 - protein, 134 aa, Artificial Sequence
  Rotavirus - VP8 Protein
PTTFTPPNDYWILINSNTNGVVYESTNNSDFWTAVVAIEPHVNPVDRQYMIFGESKQFNVSNDSNKWKFLEMFRSSSQNEFYNRRTLTSDTRLVGILKYGGRVWTFHGETPRATTDSSSAANLNNISITIHSEF

SEQ ID NO: 1173 - protein, 12 aa, Artificial Sequence
  Tumor Rejection Antigen Precursor MAGE-1
EHSAYGEPRKLL

SEQ ID NO: 1174 - protein, 183 aa, Artificial Sequence
  HBCAg (amino acid seq)
MDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 1175 - DNA, 552 bp, wild-type HBcAg
atggacatcgacccttataaagaatttggagctactgtggagttactctcgtttttgccctccgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcgtctagagacctagtagtcagttatgtcaacactaatatgggcctaaagttcaggcaactcttgtggtttcacatttcttgtctcacttttggaagagaaacagttatagagtatttggtgtctttcggagtgtggattcgcactcctccagcttatagaccaccaaatgcccctatcctatcaacacttccggagactactgttgttagacgacgaggcaggtcccctagaagaagaactccctcgcctcgcagacgaaggtctcaatcgccgcgtcgcagaagatctcaatctcgggaatctcaatgttag

SEQ ID NO: 1176 - DNA, 552 bp, Artificial Sequence
  HBCAg (codon optimized nt seq)
atggacatcgacccctacaaggagttcggcgccaccgtggagctgctgagcttcctgcccagcgacttcttccccagcgtgcgcgacctgctggacaccgccagcgccctgtaccgcgaggccctggagagccccgagcactgcagcccccaccacaccgccctgcgccaggccatcctgtgctggggcgagctgatgaccctggccacctgggtgggcgtgaacctggaggaccccgccagccgcgacctggtggtgagctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1177 - protein, 18 aa, Artificial Sequence
  NS3/4A junction (amino acid sequence)
SADLEVVTSTWVLVGGVL

SEQ ID NO: 1178 - DNA, 54 bp, Artificial Sequence
  NS3/4A junction (codon optimized nt seq)
agcgccgacctggaggtggtgaccagcacctgggtgctggtgggcggcgtgctg

SEQ ID NO: 1179 - protein, 16 aa, Artificial Sequence
  NS4A/B junction (amino acid sequence)
DEMEECSQHLPYIEQG

SEQ ID NO: 1180 - DNA, 48 bp, Artificial Sequence
  NS4A/B junction (nucleotide sequence)
gacgagatggaggagtgcagccagcacctgccctacatcgagcagggc

SEQ ID NO: 1181 - protein, 869 aa, Artificial Sequence
  CONSTR-1 NS3/4A-HBcAg (NS3-NS4A-HBcAg fusion with active protease) (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTPTWVLVGGVLAALAAYCLSTGCVVIVGRIVLSGKPAIIPDREVLYREFDEMEECMDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 1182 - DNA, 2610 bp, Artificial Sequence
  NS3/4A-HBcAg (NS3-NS4A-HBcAg fusion with active protease) (nucleotide sequence sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgacccccacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcatggacatcgacccctacaaggagttcggcgccaccgtggagctgctgagcttcctgcccagcgacttcttccccagcgtgcgcgacctgctggacaccgccagcgccctgtaccgcgaggccctggagagccccgagcactgcagcccccaccacaccgccctgcgccaggccatcctgtgctggggcgagctgatgaccctggccacctgggtgggcgtgaacctggaggaccccgccagccgcgacctggtggtgagctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1183 - protein, 869 aa, Artificial Sequence
  CONSTR-2 Mutant(catalytic triade)NS3/4A-HBcAg (NS3-NS4A-HBcAg fusion with inactive protease) (amino acid sequence)
MAPITAYAQQTRGLLGCIITSLTGRDKNQVEGEVQIVSTAAQTFLATCINGVCWTVYAGAGTRTIASPKGPVIQMYTNVDQALVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECMDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 1184 - DNA, 2610 bp, Artificial Sequence
  Mutant(catalytic triade)NS3/4A-HBcAg (NS3-NS4A-HBcAg fusion with inactive protease) (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtacgccggcgccggcacccgcaccatcgccagccccaagggccccgtgatccagatgtacaccaacgtggaccaggccctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcatggacatcgacccctacaaggagttcggcgccaccgtggagctgctgagcttcctgcccagcgacttcttccccagcgtgcgcgacctgctggacaccgccagcgccctgtaccgcgaggccctggagagccccgagcactgcagcccccaccacaccgccctgcgccaggccatcctgtgctggggcgagctgatgaccctggccacctgggtgggcgtgaacctggaggaccccgccagccgcgacctggtggtgagctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1185 - protein, 869 aa, Artificial Sequence
  CONSTR-3 NS3/4A-HBcAg (NS3 and NS4A-HBcAg fusion) (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECMDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 1186 - DNA, 2610 bp, Artificial Sequence
  NS3/4A-HBcAg (NS3 and NS4A-HBcAg fusion) (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcatggacatcgacccctacaaggagttcggcgccaccgtggagctgctgagcttcctgcccagcgacttcttccccagcgtgcgcgacctgctggacaccgccagcgccctgtaccgcgaggccctggagagccccgagcactgcagcccccaccacaccgccctgcgccaggccatcctgtgctggggcgagctgatgaccctggccacctgggtgggcgtgaacctggaggaccccgccagccgcgacctggtggtgagctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1187 - protein, 879 aa, Artificial Sequence
  CONSTR-4 NS3/4A-4Bjunct-HBcAg (NS3 AND NS4A AND HBcAg) (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 1188 - DNA, 2640 bp, Artificial Sequence
  NS3/4A-4Bjunct-HBcAg (NS3 AND NS4A AND HBcAg) (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatggacatcgacccctacaaggagttcggcgccaccgtggagctgctgagcttcctgcccagcgacttcttccccagcgtgcgcgacctgctggacaccgccagcgccctgtaccgcgaggccctggagagccccgagcactgcagcccccaccacaccgccctgcgccaggccatcctgtgctggggcgagctgatgaccctggccacctgggtgggcgtgaacctggaggaccccgccagccgcgacctggtggtgagctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1189 - protein, 933 aa, Artificial Sequence
  CONSTR-5 NS3/4A-4Bjunct-HBcAg1-44-NS3/4Ajunct-HBc45-87-NS3/ 4Ajunct-HBc88-141-NS3/4Ajunct-HBc142-183 (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMDIDPYKEFGATVELLSFLPSDFFPSVRDLLDTASALYREALESSADLEVVTSTWVLVGGVLPEHCSPHHTALRQAILCWGELMTLATWVGVNLEDPASRDLVVSSADLEVVTSTWVLVGGVLYVNTNMGLKFRQLLWFHISCLTFGRETVIEYLVSFGVWIRTPPAYRPPNAPILSSADLEVVTSTWVLVGGVLTLPETTVVRRRGRSPRRRTPSPRRRRSQSPRRRRSQSRESQC

SEQ ID NO: 1190 - DNA, 2802 bp, Artificial Sequence
  NS3/4A-4Bjunct-HBcAg1-44-NS3/4Ajunct-HBc45-87-NS3/ 4Ajunct-HBc88-141-NS3/4Ajunct-HBc142-183 (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcatggacatcgacccctacaaggagttcggcgccaccgtggagctgctgagcttcctgcccagcgacttcttccccagcgtgcgcgacctgctggacaccgccagcgccctgtaccgcgaggccctggagagcagcgccgacctggaggtggtgaccagcacctgggtgctggtgggcggcgtgctgcccgagcactgcagcccccaccacaccgccctgcgccaggccatcctgtgctggggcgagctgatgaccctggccacctgggtgggcgtgaacctggaggaccccgccagccgcgacctggtggtgagcagcgccgacctggaggtggtgaccagcacctgggtgctggtgggcggcgtgctgtacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcagcgccgacctggaggtggtgaccagcacctgggtgctggtgggcggcgtgctgaccctgcccgagaccaccgtggtgcgccgccgcggccgcagcccccgccgccgcacccccagcccccgccgccgccgcagccagagcccccgccgccgccgcagccagagccgcgagagccagtgctag

SEQ ID NO: 1191 - protein, 933 aa, Artificial Sequence
  CONSTR-6 NS3/4A-4Bjunct-HBcAg142-183-NS3/4Ajunct-HBc45-87-N S3/4Ajunct-HBc88-141-NS3/4Ajunct-HBc1-44 (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGTLPETTVVRRRGRSPRRRTPSPRRRRSQSPRRRRSQSRESQCSADLEVVTSTWVLVGGVLPEHCSPHHTALRQAILCWGELMTLATWVGVNLEDPASRDLVVSSADLEVVTSTWVLVGGVLYVNTNMGLKFRQLLWFHISCLTFGRETVIEYLVSFGVWIRTPPAYRPPNAPILSSADLEVVTSTWVLVGGVLMDIDPYKEFGATVELLSFLPSDFFPSVRDLLDTASALYREALES

SEQ ID NO: 1192 - DNA, 2802 bp, Artificial Sequence
  NS3/4A-4Bjunct-HBcAg142-183-NS3/4Ajunct-HBc45-87-N S3/4Ajunct-HBc88-141-NS3/4Ajunct-HBc1-44 (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcaccctgcccgagaccaccgtggtgcgccgccgcggccgcagcccccgccgccgcacccccagcccccgccgccgccgcagccagagcccccgccgccgccgcagccagagccgcgagagccagtgcagcgccgacctggaggtggtgaccagcacctgggtgctggtgggcggcgtgctgcccgagcactgcagcccccaccacaccgccctgcgccaggccatcctgtgctggggcgagctgatgaccctggccacctgggtgggcgtgaacctggaggaccccgccagccgcgacctggtggtgagcagcgccgacctggaggtggtgaccagcacctgggtgctggtgggcggcgtgctgtacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcagcgccgacctggaggtggtgaccagcacctgggtgctggtgggcggcgtgctgatggacatcgacccctacaaggagttcggcgccaccgtggagctgctgagcttcctgcccagcgacttcttccccagcgtgcgcgacctgctggacaccgccagcgccctgtaccgcgaggccctggagagctag

SEQ ID NO: 1193 - protein, 933 aa, Artificial Sequence
  CONSTR-7 NS3/4A-4Bjunct-HBcAg142-183-NS3/4Ajunct-HBc88-141- NS3/4Ajunct-HBc45-87-NS3/4Ajunct-HBc1-44 (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGTLPETTVVRRRGRSPRRRTPSPRRRRSQSPRRRRSQSRESQCSADLEVVTSTWVLVGGVLYVNTNMGLKFRQLLWFHISCLTFGRETVIEYLVSFGVWIRTPPAYRPPNAPILSSADLEVVTSTWVLVGGVLPEHCSPHHTALRQAILCWGELMTLATWVGVNLEDPASRDLVVSSADLEVVTSTWVLVGGVLMDIDPYKEFGATVELLSFLPSDFFPSVRDLLDTASALYREALES

SEQ ID NO: 1194 - DNA, 2802 bp, Artificial Sequence
  NS3/4A-4Bjunct-HBcAg142-183-NS3/4Ajunct-HBc88-141- NS3/4Ajunct-HBc45-87-NS3/4Ajunct-HBc1-44 (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcaccctgcccgagaccaccgtggtgcgccgccgcggccgcagcccccgccgccgcacccccagcccccgccgccgccgcagccagagcccccgccgccgccgcagccagagccgcgagagccagtgcagcgccgacctggaggtggtgaccagcacctgggtgctggtgggcggcgtgctgtacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcagcgccgacctggaggtggtgaccagcacctgggtgctggtgggcggcgtgctgcccgagcactgcagcccccaccacaccgccctgcgccaggccatcctgtgctggggcgagctgatgaccctggccacctgggtgggcgtgaacctggaggaccccgccagccgcgacctggtggtgagcagcgccgacctggaggtggtgaccagcacctgggtgctggtgggcggcgtgctgatggacatcgacccctacaaggagttcggcgccaccgtggagctgctgagcttcctgcccagcgacttcttccccagcgtgcgcgacctgctggacaccgccagcgccctgtaccgcgaggccctggagagctag

SEQ ID NO: 1195 - protein, 933 aa, Artificial Sequence
  CONSTR-8 NS3/4A-4Bjunct-HBcAg142-183-NS3/4Ajunct-HBc88-141- NS3/4Ajunct-HBc1-44-NS3/4Ajunct-HBc45-87 (amino acid sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGTLPETTVVRRRGRSPRRRTPSPRRRRSQSPRRRRSQSRESQCSADLEVVTSTWVLVGGVLYVNTNMGLKFRQLLWFHISCLTFGRETVIEYLVSFGVWIRTPPAYRPPNAPILSSADLEVVTSTWVLVGGVLMDIDPYKEFGATVELLSFLPSDFFPSVRDLLDTASALYREALESSADLEVVTSTWVLVGGVLPEHCSPHHTALRQAILCWGELMTLATWVGVNLEDPASRDLVVS

SEQ ID NO: 1196 - DNA, 2802 bp, Artificial Sequence
  NS3/4A-4Bjunct-HBcAg142-183-NS3/4Ajunct-HBc88-141- NS3/4Ajunct-HBc1-44-NS3/4Ajunct-HBc45-87 (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggcaccctgcccgagaccaccgtggtgcgccgccgcggccgcagcccccgccgccgcacccccagcccccgccgccgccgcagccagagcccccgccgccgccgcagccagagccgcgagagccagtgcagcgccgacctggaggtggtgaccagcacctgggtgctggtgggcggcgtgctgtacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcagcgccgacctggaggtggtgaccagcacctgggtgctggtgggcggcgtgctgatggacatcgacccctacaaggagttcggcgccaccgtggagctgctgagcttcctgcccagcgacttcttccccagcgtgcgcgacctgctggacaccgccagcgccctgtaccgcgaggccctggagagcagcgccgacctggaggtggtgaccagcacctgggtgctggtgggcggcgtgctgcccgagcactgcagcccccaccacaccgccctgcgccaggccatcctgtgctggggcgagctgatgaccctggccacctgggtgggcgtgaacctggaggaccccgccagccgcgacctggtggtgagctag

SEQ ID NO: 1197 - protein, 933 aa, Artificial Sequence
  NS3/4A-4Bjunct-HBcAg142-183-NS3/4Ajunct-HBc88-141- NS3/4Ajunct-HBc1-44-NS3/4Ajunct-HBc45-87 (nucleotide sequence)
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGYVNTNMGLKFRQLLWFHISCLTFGRETVIEYLVSFGVWIRTPPAYRPPNAPILSSADLEVVTSTWVLVGGVLTLPETTVVRRRGRSPRRRTPSPRRRRSQSPRRRRSQSRESQCSADLEVVTSTWVLVGGVLMDIDPYKEFGATVELLSFLPSDFFPSVRDLLDTASALYREALESSADLEVVTSTWVLVGGVLPEHCSPHHTALRQAILCWGELMTLATWVGVNLEDPASRDLVVS

SEQ ID NO: 1198 - DNA, 2802 bp, Artificial Sequence
  NS3/4A-4Bjunct-HBcAg88-141-NS3/4Ajunct-HBc142-183- NS3/4Ajunct-HBc1-44-NS3/4Ajunct-HBc45-87 (nucleotide sequence)
atggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgcagccagcacctgccctacatcgagcagggctacgtgaacaccaacatgggcctgaagttccgccagctgctgtggttccacatcagctgcctgaccttcggccgcgagaccgtgatcgagtacctggtgagcttcggcgtgtggatccgcaccccccccgcctaccgcccccccaacgcccccatcctgagcagcgccgacctggaggtggtgaccagcacctgggtgctggtgggcggcgtgctgaccctgcccgagaccaccgtggtgcgccgccgcggccgcagcccccgccgccgcacccccagcccccgccgccgccgcagccagagcccccgccgccgccgcagccagagccgcgagagccagtgcagcgccgacctggaggtggtgaccagcacctgggtgctggtgggcggcgtgctgatggacatcgacccctacaaggagttcggcgccaccgtggagctgctgagcttcctgcccagcgacttcttccccagcgtgcgcgacctgctggacaccgccagcgccctgtaccgcgaggccctggagagcagcgccgacctggaggtggtgaccagcacctgggtgctggtgggcggcgtgctgcccgagcactgcagcccccaccacaccgccctgcgccaggccatcctgtgctggggcgagctgatgaccctggccacctgggtgggcgtgaacctggaggaccccgccagccgcgacctggtggtgagctag

SEQ ID NO: 1199 - protein, 685 aa, Artificial Sequence
  Mutant Hepatitis C virus NS3/4A peptide
APITAYAQQTRGLLGCIITSLTGRDKNQAEGEVAIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1200 - protein, 685 aa, Artificial Sequence
  Mutant Hepatitis C virus NS3/4A peptide
  VARIANT 27: Xaa is anything but Asn
APITAYAQQTRGLLGCIITSLTGRDKXQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1201 - protein, 685 aa, Artificial Sequence
  Mutant Hepatitis C virus NS3/4A peptide
  VARIANT 28: Xaa is anything but Gln
APITAYAQQTRGLLGCIITSLTGRDKNXVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1202 - protein, 685 aa, Artificial Sequence
  Mutant Hepatitis C virus NS3/4A peptide
  VARIANT 29: Xaa is anything but Val
APITAYAQQTRGLLGCIITSLTGRDKNQXEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1203 - protein, 685 aa, Artificial Sequence
  Mutant Hepatitis C virus NS3/4A peptide
  VARIANT 30: Xaa is anything but Glu
APITAYAQQTRGLLGCIITSLTGRDKNQVXGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1204 - protein, 685 aa, Artificial Sequence
  Mutant Hepatitis C virus NS3/4A peptide
  VARIANT 31: Xaa is anything but Gly
APITAYAQQTRGLLGCIITSLTGRDKNQVEXEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1205 - protein, 685 aa, Artificial Sequence
  Mutant Hepatitis C virus NS3/4A peptide
  VARIANT 32: Xaa is anything but Glu
APITAYAQQTRGLLGCIITSLTGRDKNQVEGXVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1206 - protein, 685 aa, Artificial Sequence
  Mutant Hepatitis C virus NS3/4A peptide
  VARIANT 33: Xaa is anything but Val
APITAYAQQTRGLLGCIITSLTGRDKNQVEGEXQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1207 - protein, 685 aa, Artificial Sequence
  Mutant Hepatitis C virus NS3/4A peptide
  VARIANT 34: Xaa is anything but Gln
APITAYAQQTRGLLGCIITSLTGRDKNQVEGEVXIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1208 - protein, 685 aa, Artificial Sequence
  Mutant Hepatitis C virus NS3/4A peptide
  VARIANT 35: Xaa is anything but Ile
APITAYAQQTRGLLGCIITSLTGRDKNQVEGEVQXVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1209 - protein, 685 aa, Artificial Sequence
  Mutant Hepatitis C virus NS3/4A peptide
  VARIANT 36: Xaa is anything but Val
APITAYAQQTRGLLGCIITSLTGRDKNQVEGEVQIXSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 1210 - DNA, 9994 bp, SIV/HIV
tggaagggatttattacagtgcaagaagacatagaatcttagacatgtacttagaaaaggaaaaaggcatcataccagattggcaggattacacctcaggaccaggaattagatacccaaagacatttggctggctatggaaattagtccctgtaaatgtatcagatgaggcacaggaggatgaagagcattatttaatgcatccagctcaaacttcccagtgggatgacccttggagagaggttctagcatggaagtttgatccaactctggcctacacttatgaggcatatgttagatacccagaagagtttggaagcaagtcaggcctgtcagaggaagaggttaaaagaaggctaaccgcaagaggccttcttaacatggctgacaagaaggaaactcgctgaaacagcagggactttccacaaggggatgttacggggaggtactggggaggagccggtcgggaacgcccactttcttgatgtataaatatcactgcatttcgctctgtattcagtcgctctgcggagaggctggcaggttgagccctgggaggttctctccagcactagcaggtagagcctgggtgttccctgctagactctcaccagcacttggccggtgctgggcagagtgattccacgcttgcttgcttaaagccctcttcaataaagctgccattttagaagtaagctagtgtgtgttcccatctctcctagccgccgcctggtcaactcggtactcaataataagaagaccctggtctgttaggaccctttctgctttgggaaaccgaagcaggaaaatccctagcagattggcgcccgaacagggacgcgaaagcgaaagtagaaccagaggagctctctcgacgcaggactcggcttgctgaagcgcgcacggcaagaggcgaggggcggcgactggtgagtacgccatttttgactagcggaggctagaaggagagagatgggtgcgagagcgtcaatattaagcgggggacaattagatagatgggaaaaaattcggttacggccagggggaaagaaaagatataagttaaaacatatagtatgggcaagcagagagctagaacgattcgcagttaaccctggcctgttagaaacagcagaaggctgtagacaaatactgggacagctacaaccatcccttcagacaggatcagaggaacttaaatcattatttaatacaatagctaccctctattgtgtacatcaaagaatagagataaaagacaccaaggaagctttagataagatagaggaagagcaaaacaaaagtaagaaaaaagcacagcaagcagcagctgacacaggaaacagcagcagccaagtcagccaaaattaccctatagtgcagaacgctcagggacaaatggtacatcaggccatatcacctagaactttaaatgcatgggtaaaagtagtagaagaaaaggcttttaacccagaagtaatacccatgtttgcagcattgtcagaaggagccaccccacaagatttaaacaccatgctaaacacagtggggggacatcaagcagccatgcaaatattaaaagagactatcaatgaggaagctgcagaatgggatagattgcatccagtacatgcagggcctattgcaccaggccaaatgagagaaccaaggggaagtgacatagcaggaactactagtacccttcaggaacaaataggatggatgacaaataatccacctatcccagtaggagaaatctataaaaaatggataatcatgggattaaataaaattgtaaggatgtatagccctaccagtattctggacataagacaaggaccaaaggaaccctttagagactatgtagaccggttctataaaactctaagagccgagcaagcttcacaggaagtaaaaaattggatgacagaaaccttgttggtccaaaattcaaaccccgattgtaagactattttaaaagcattaggaccaggagctacactagaagaaatgatgacagcatgccagggagtgggaggacctggccataaagcaagagttttggcagaagcaatgagccaagtaacaaatccaacggccgtgatgatgcagaaaagcaattttaggggccaaagaaaaattgttaagtgttttaattgtggcaaagaagggcacatagccaaaaattgcagggctcctagaaaaaagggctgttggaaatgtggaaaggaaggacaccaaatgaaagattgtactgaaagacaggctaattttttagggaagatctggccttcctacaagggaaggccagggaattttcctcaaagcaggctagaaccaacagccccaccagaagcgagcttcaggtttggggaggagacaacaactccccctcagaagcaggagacgatagacaaggaggtgtatcctttaacctccctcagatcactctttggcaacgacccctcgtcacaataaagataggggggcaactaaaagaagctctattagatacaggagcagatgatacagtgttagaagacatgaatttgccaggaaaatggaaaccaaaaatgatagggggaattggaggatttatcaaagtaaaacagtatgatcagatacccatagaaatctgtggacataaaactataggtacagtattaataggacctacacctgtcaacataattggaaggaatttgttgactcagcttggttgcactttaaattttcccattagtcctattgaaactgtaccagtaaaattaaagccaggaatggatggcccaaaagttaagcaatggccattgacagaagaaaaaataaaagcattaatggagatatgcacagaaatggaaaaggaagggaaaatttcaaaaattgggcctgaaaatccatacaatactccagtgtttgccataaagaaaaaagacagtactaagtggagaaaattagtagatttcagagaacttaataagaaaactcaagacttctgggaggttcaattaggaataccacatcccgcggggttaaaaaagaaaaagtcagtaacagtactggatgtgggtgatgcatacttctcagttcccttagatgaagattttaggaagtatactgcatttaccatacctagtataaacaatgagacatcaggaattagatatcagtacaatgtgcttccacagggatggaaagggtcaccatgtcagatcccagggagagaatcccacctggaaacagtggagaagagacaataggagaggccttcgaatggctaaacagaacagtagaggagataaacagagaggcggtaaaccacctaccaagggagctaattttccaggtttggcaaaggtcttgggaatactggcatgatgaacaagggatgtcaccaagctatgtaaaatacagatacttgtgtttaatacaaaaggctttatttatgcattgcaagaaaggctgtagatgtctaggggaaggacatggggcagggggatggagaccaggacctcctcctcctccccctccaggactagcataaatggaagaaagacctccagaaaatgaaggaccacaaagggaaccatgggatgaatgggtagtggaggttttggaagaactgaaagaagaagctttaaaacattttgatcctcgcttgctaactgcccttggtaatcatatctataatcgtcacggagacactctagagggagcaggagaactcattagaatcctccaacgagcgctcttcatgcatttcagaggcggatgcatccactccagaatcggccaacctgagggaggaaatcctctctcagctataccgccctctagaagcattctgtagagcaagaaatggagccagtagatcctagactagagccctggaagcatccaggaagtaagcctaaaactgcttgtaccaattgctattgtaaaaagtgttgctttcattgccaagtttgtttcataacaaaagccttaggcatctcctatggcaggaagaagcggagacagcgacgaagagctcatcagaacagtcagactcatcaagcttctctatcaaagcagtaagtagtacatgtaatgcaacctataccaatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagagatatcagaattatcagcacttgtggagagagggcatcttgctccttgggatattaatgatatgtagcactgcaggacaattgtgggtcacagtctattatggggtacctgtgtggagagaagcaaccaccactctattttgtgcatcagatgctaaagcatatgatacagaggtgcataatgtctgggccacacatgcctgtgtacccacagaccccagcccacaagaaatggcattggaaaatgtgacagaaaattttgacatgtggaaaaataatatggtagaacagatgcatgaagatataatcagcttatgggatcaaagcctaaagccttgtgtaaaattaactccactatgtgttactttaaattgcactgatgtaaagagaaatgctactagtaacactagtagtagctgggaaaggatggaaccaggagaaataaaaaactgctctttcaatgtcacctcaaatataagagataagatgcggaaagaatatgcactcttttataaacttgatgtaataccaataaataatactagtgataatagtgctaaatatagattgataagttgtaacacctcagtccttacacaagcttgtccaaaaatatcctttgagccaattccaatacattattgtaccccggctggttttgcgcttctgaagtgtaatgataaggagttcaatggaacgggaccatgtaaaaatgtcagcacagtacaatgtacacatggaatcaagccagtagtatcaactcaactgctgttaaatggcagtctatcagaaggaggggttgtaattagatctcaaaatttcacaaacaatgctaaaaccataatagtacagctgaatgaaactgtagaaattaattgtacaaggcccaacaacaatacaagaagaagtataaatataggaccagggagagcattttatgcagcagaacaaataataggagatataagacaagcacattgtaacattagtagagcaaaatggaataacactttaaaactgatagttggaaaattacaagaacaatttgggaagaaaacaataatctttaatcaatcctcaggaggagaccctgagattgtaacacacagttttaattgtggaggggaatttttctactgtgattcaacacaactgtttaacagtacttggacgaatgaaaataacgggtccaacactaaagggaatgacacaatcatactaccatgcagaataaaacaaattgtaaacctgtggcaggaagtaggaaaagcaatgtatgcccctcccatcagaagaccaattagatgctcatcaaatattacagggctgctactaacaagagatggtggtcctaataggacgaacgagacattcagacctggaggaggagatatgagggacaattggagaagtgaattatacaaatataaagtagtaaaaattgaaccattaggagtagcacccaccaaggcaaagagaagagtggtgcaaagagaaaaaagagcagtgggaataggagctctgttccttgggttcttgggaacagcaggaagcactatgggcgcagcgtcactgacgctgacggtacaggccagacaattattgtctggtatagtgcaacagcagaacaatttgctgagagctattgaagcgcaacaacatctgttgcagctcacagtctggggcatcaagcagctccaggcaagagtcctggctgtggaaagatacctaagggatcaacagctcctgggaatttggggttgctctggaaaactcatttgcaccactgctgtgccttggaacactagttggagtaataaatctctagatgacatttggaacaacatgacttggatgcagtgggaaagagaaattgacaattacacaaacacaatatacaccttacttcaggaatcacaactccaacaagaacagaatgaaaaagaactattggaattggataaatgggcaagtttgtggaattggttcgatataacaagttggctgtggtatataaaaatattcataatgatagtaggaggcttgataggtttaagaatagtttttactgtactttctatagtgaatagagttaggaagggatactcaccattatcgttccagacccaccgcccagctccagggggacccgacaggcccgaaggaatcgaagaagaaggtggagagagagacagagaaagatccaatcaattagtggatggattcttagcaattatctgggtcgacctgcggaacctgtgcctcttcagctaccaccgcttgagagacttactcttgattgcaacgaggattgtggaacttctgggacgcagggggtgggaagccctcaaatattggtggaatctcctgcagtattggagtcaggaactgaagaatagtgctgttagcttgcttaatgccatagccatagcagtagctgaggggacagatagaattatagaagtagtacaaaggggggttagagctgttcttaacatacccacaagaataagacagggagcggaaaggcttcttgtataagatgggtggcaagttgtcaaaaagtaagatgcctggatggtctactataagggaaagaatgagacgagctcagccagcagcagagccagcagcagttggggtgggagcagcatctcgagacctggaaagacatggagcactcacaagtagcaatacagcagctaacaatgctgattgtgcctggctagaagcacaagaggacgaggaagtgggttttccagtcagacctcaggtacctcttaggccaatgacttacaagggagctgtagatcttagccactttttaaaagaaaaggggggactggaagggttagtttactcccaaaaaagacaagacatccttgatctgtgggtctaccacacacaaggctacttccctgattggcagaactacacaccagggccagggatcagatatcccctgacctttggatggtgcttcaagctagtaccagttgatccagataaggtagaagaggccaatgaaggagagaacaactgcttattacaccctatggcccagcatgggatggatgacccagagaaagaagtgttagtgtggaagtttgacagccgcctagcatttcatcacatggcccgagagctgcatccggagtactacaaagactgctgagcggccgccctgcaggtcgacctcgagggggggcccggtaccttaattaattaaggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattc

SEQ ID NO: 1211 - DNA, 4980 bp, SIV/HIV
cgcccgaacagggacttgaaggagagtgagagactcctgagtacggctgagtgaaggcagtaagggcggcaggaaccaaccacgacggagtgctcctataaaggcgcgggtcggtaccagacggcgtgaggagcgggagaggaagaggcctccggttgcaggtgagtgcaacacaaaaaagaaatagctgtcttttatccaggaaggggtaataagatagagtgggagatgggcgtgagaaactccgtcttgtcagggaagaaagcagatgaattagaaaaaattaggctacgacccaacggaaagaaaaagtacatgttgaagcatgtagtatgggcagcaaatgaattagatagatttggattagcagaaagcctgttggagaacaaagaaggatgtcaaaaaatactttcggtcttagctccattagtgccaacaggctcagaaaatttaaaaagcctttataatactgtctgcgtcatctggtgcattcacgcagaagagaaagtgaaacacactgaggaagcaaaacagatagtgcagagacacctagtggtggaaataggaacaacagaaactatgccaaaaacaagtagaccaacagcaccatctagcggcagaggaggaaattacccagtacaacaaataggtggtaactatgtccacctgccattaagcccgagaacattaaatgcctgggtaaaattgatagaggaaaagaaatttggagcagaagtagtgccaggatttcaggcactgtcagaaggttgcaccccctatgacattaatcagatgttaaattgtgtgggagaccatcaagcggctatgcagattatcagagatattataaacgaggaggctgcagattgggacttgcagcacccacaaccagctccacaacaaggacaacttagggagccgtcaggatcagatattgcaggaacaactagttcagtagatgaacaaatccagtggatgtacagacaacagaaccccataccagtaggcaacatttacaggagatggatccaactggggttgcaaaaatgtgtcagaatgtataacccaacaaacattctagatgtaaaacaagggccaaaagagccatttcagagctatgtagacaggttctacaaaagtttaagagcagaacagacagatgcagcagtaaagaattggatgactcaaacactgctgattcaaaatgctaacccagattgcaagctagtgctgaaggggctgggtgtgaatcccaccctagaagaaatgctgacggcttgtcaaggagtaggggggccgggacagaaggctagattaatggcagaagccctgaaagaggccctcgcaccagtgcctatcccttttgcagcagcccaacagaggggaccaagaaagccaattaagtgttggaattgtgggaaagagggacactctgcaaggcaatgcagagccccaagaagacagggatgctggaaatgtggaaaaatggaccatgttatggccaaatgcccagacagacaggcgggttttttaggccttggtccatggggaaagaagccccgcaatttccccatggctcaagtgcatcaggggctgatgccaactgctcccccagaggacccagctgtggatctgctaaagaactacatgcagttgggcaagcagcagagagaaaagcagagagaaagcagagagaagccttacaaggaggtgacagaggatttgctgcacctcaattctctctttggaggagaccagtagtcactgctcatattgaaggacagcctgtagaagtattactggatacaggggctgatgattctattgtaacaggaatagagttaggtccacattataccccaaaaatagtaggaggaataggaggttttattaatactaaagaatacaaaaatgtagaaatagaagttttaggcaaaaggattaaagggacaatcatgacaggggacaccccgattaacatttttggtagaaatttgctaacagctctggggatgtctctaaattttcccatagctaaagtagagcctgtaaaagtcgccttaaagccaggaaagaatggaccaaaattgaagcagtggccattatcaaaagaaaagatagttgcattaagagaaatctgggaaaagatggaaaaggatggtcagttggaggaagctcccccgaccaatccatacaacacccccacatttgctataaagaaaaaggataagaacaaatggagaatgctgatagattttagggaactaaatagggtcactcaggactttacggaagtccaattaggaataccacaccctgcaggattagcaaaaaggaaaagaattacagtactggatataggtgatgcatatttctccatacctctagatgaagaatttaggcagtacactgcctttactttaccatcagtaaataatgcagagccaggaaaacgatacatttataaggttctgcctcagggatggaaggggtcaccagccatcttccaatacactatgagacatgtgctagaacccttcaggaaggcaaatccagatgtgaccttagtccagtatatggatgacatcttaatagctagtgacaggacagacctggaacatgacagggtagttttacagtcaaaggaactcttgaatagcatagggttttctaccccagaagagaaattccaaaaagatcccccatttcaatggatggggtacgaattgtggccaacaaaatggaagttgcaaaagatagagttgccacaaagagagacctggacagtgaatgatatacagaagttagtaggagtattaaattgggcagctcaaatttatccaggtataaaaaccaaacatctctgtaggttaattagaggaaaaatgactctaacagaggaagttcagtggactgagatggcagaagcagaatatgaggaaaataaaataattctcagtcaggaacaagaaggatgttattaccaagaaggcaagccattagaagccacggtaataaagagtcaggacaatcagtggtcttataaaattcaccaagaagacaaaatactgaaagtaggaaaatttgcaaagataaagaatacacataccaatggagtgagactattagcacatgtaatacagaaaataggaaaggaagcaatagtgatctggggacaggtcccaaaattccacttaccagttgagaaggatgtatgggaacagtggtggacagactattggcaggtaacctggataccggaatgggattttatctcaacaccaccgctagtaagattagtcttcaatctagtgaaggaccctatagagggagaagaaacctattatacagatggatcgtgtaataaacagtcaaaagaagggaaagcaggatatatcacagataggggcaaagacaaagtaaaagtgttagaacagactactaatcaacaagcagaattggaagcatttctcatggcattgacagactcagggccaaaggcaaatattatagtagattcacaatatgttatgggaataataacaggatgccctacagaatcagagagcaggctagttaatcaaataatagaagaaatgattaaaaagtcagaaatttatgtagcatgggtaccagcacacaaaggtataggaggaaaccaagaaatagaccacctagttagtcaagggattagacaagttctcttcttggaaaagatagagccagcacaagaagaacatgataaataccatagtaatgtaaaagaattggtattcaaatttggattacccagaatagtggccagacagatagtagacacctgtgataaatgccatcagaaaggagaggctatacatgggcaggtaaattcagatctagggacttggcaaatggattgtacccatctagagggaaaaataatcatagttgcagtacatgtagctagtggattcatagaagcagaggtaattccacaagagacaggaagacagacagcactatttctgttaaaattggcaggcagatggcctattacacatctacacacagataatggtgctaactttgcttcgcaagaagtaaagatggttgcatggtgggcagggatagagcacacctttggggtaccatacaatccacagagtcagggagtagtggaagcaatgaatcaccacctgaaaaatcaaatagatagaatcagggaacaagcaaattcagtagaaaccatagtattaatggcagttcattgcatgaattttaaaagaaggggaggaataggggatatgactccagcagaaagattaattaacatgatcactacagaacaagagatacaatttcaacaatcaaaaaactcaaaatttaaaaattttcgggtctattacagagaaggcagagatcaactgtggaagggacccggtgagctattgtggaaaggggaaggagcagtcatcttaaaggtagggacagacattaaggtagtacccagaagaaaggctaaaattatcaaagattatggaggaggaaaagaggtggatagcagttcccacatggaggataccggagaggttagagaggtggcatagcctcataaaatatctgaaatataaaactaaagatctacaaaaggtttgctatgtgccccattttaaggtcggatgggcatggtggacctgcagcagagtaatcttcccactacaggaaggaagccatttagaagtacaagggtattggcatttgacaccagaaaaagggtggctcagtacttatgcagtgaggataacctggtactcaaagaacttttggacagatgtaacaccaaactatgcagacattttactgcatagcacttatttcccttgctttacagcgggagaagtgagaagggccatcaggggagaacaactgctgtcttgctgcaggttcccgagagctcataagcaccaggtaccaagcctacagtacttagcactgaaagta

SEQ ID NO: 1212 - DNA, 472 bp, SIV/HIV
atggaggaggaaaagaggtggatagcagttcccacatggaggataccggagaggttagagaggtggcatagcctcataaaatatctgaaatataaaactaaagatctacaaaaggtttgctatgtgccccattttaaggtcggatgggcatggtggacctgcagcagagtaatcttcccactacaggaaggaagccatttagaagtacaagggtattggcatttgacaccagaaaaagggtggctcagtacttatgcagtgaggataacctggtactcaaagaacttttggacagatgtaacaccaaactatgcagacattttactgcatagcacttatttcccttgctttacagcgggagaagtgagaagggccatcaggggagaacaactgctgtcttgctgcaggttcccgagagctcataagcaccaggtaccaagcctacagtacttagcactgaaagtagtaagcg

SEQ ID NO: 1213 - DNA, 2376 bp, SIV/HIV
cgcccgaacagggacgcgaaagcgaaagtagaaccagaggagctctctcgacgcaggactcggcttgctgaagcgcgcacggcaagaggcgaggggcggcgactggtgagtacgccatttttgactagcggaggctagaaggagagagatgggtgcgagagcgtcaatattaagcgggggacaattagatagatgggaaaaaattcggttacggccagggggaaagaaaagatataagttaaaacatatagtatgggcaagcagagagctagaacgattcgcagttaaccctggcctgttagaaacagcagaaggctgtagacaaatactgggacagctacaaccatcccttcagacaggatcagaggaacttaaatcattatttaatacaatagctaccctctattgtgtacatcaaagaatagagataaaagacaccaaggaagctttagataagatagaggaagagcaaaacaaaagtaagaaaaaagcacagcaagcagcagctgacacaggaaacagcagcagccaagtcagccaaaattaccctatagtgcagaacgctcagggacaaatggtacatcaggccatatcacctagaactttaaatgcatgggtaaaagtagtagaagaaaaggcttttaacccagaagtaatacccatgtttgcagcattgtcagaaggagccaccccacaagatttaaacaccatgctaaacacagtggggggacatcaagcagccatgcaaatattaaaagagactatcaatgaggaagctgcagaatgggatagattgcatccagtacatgcagggcctattgcaccaggccaaatgagagaaccaaggggaagtgacatagcaggaactactagtacccttcaggaacaaataggatggatgacaaataatccacctatcccagtaggagaaatctataaaaaatggataatcatgggattaaataaaattgtaaggatgtatagccctaccagtattctggacataagacaaggaccaaaggaaccctttagagactatgtagaccggttctataaaactctaagagccgagcaagcttcacaggaagtaaaaaattggatgacagaaaccttgttggtccaaaattcaaaccccgattgtaagactattttaaaagcattaggaccaggagctacactagaagaaatgatgacagcatgccagggagtgggaggacctggccataaagcaagagttttggcagaagcaatgagccaagtaacaaatccaacggccgtgatgatgcagaaaagcaattttaggggccaaagaaaaattgttaagtgttttaattgtggcaaagaagggcacatagccaaaaattgcagggctcctagaaaaaagggctgttggaaatgtggaaaggaaggacaccaaatgaaagattgtactgaaagacaggctaattttttagggaagatctggccttcctacaagggaaggccagggaattttcctcaaagcaggctagaaccaacagccccaccagaagcgagcttcaggtttggggaggagacaacaactccccctcagaagcaggagacgatagacaaggaggtgtatcctttaacctccctcagatcactctttggcaacgacccctcgtcacaataaagataggggggcaactaaaagaagctctattagatacaggagcagatgatacagtgttagaagacatgaatttgccaggaaaatggaaaccaaaaatgatagggggaattggaggatttatcaaagtaaaacagtatgatcagatacccatagaaatctgtggacataaaactataggtacagtattaataggacctacacctgtcaacataattggaaggaatttgttgactcagcttggttgcactttaaattttcccattagtcctattgaaactgtaccagtaaaattaaagccaggaatggatggcccaaaagttaagcaatggccattgacagaagaaaaaataaaagcattaatggagatatgcacagaaatggaaaaggaagggaaaatttcaaaaattgggcctgaaaatccatacaatactccagtgtttgccataaagaaaaaagacagtactaagtggagaaaattagtagatttcagagaacttaataagaaaactcaagacttctgggaggttcaattaggaataccacatcccgcggggttaaaaaagaaaaagtcagtaacagtactggatgtgggtgatgcatacttctcagttcccttagatgaagattttaggaagtatactgcatttaccatacctagtataaacaatgagacatcaggaattagatatcagtacaatgtgcttccacagggatggaaaggg

SEQ ID NO: 1214 - DNA, 411 bp, HIV
aacagcagggactttccacaaggggatgttacggggaggtactggggaggagccggtcgggaacgcccactttcttgatgtataaatatcactgcatttcgctctgtattcagtcgctctgcggagaggctggcaggttgagccctgggaggttctctccagcactagcaggtagagcctgggtgttccctgctagactctcaccagcacttggccggtgctgggcagagtgattccacgcttgcttgcttaaagccctcttcaataaagctgccattttagaagtaagctagtgtgtgttcccatctctcctagccgccgcctggtcaactcggtactcaataataagaagaccctggtctgttaggaccctttctgctttgggaaaccgaagcaggaaaatccctagca

SEQ ID NO: 1215 - DNA, 481 bp, SV40
tcgagggggggcccggtaccttaattaattaaggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaa

SEQ ID NO: 1216 - DNA, 818 bp, SIV
tggaagggatttattacagtgcaagaagacatagaatcttagacatgtacttagaaaaggaaaaaggcatcataccagattggcaggattacacctcaggaccaggaattagatacccaaagacatttggctggctatggaaattagtccctgtaaatgtatcagatgaggcacaggaggatgaagagcattatttaatgcatccagctcaaacttcccagtgggatgacccttggagagaggttctagcatggaagtttgatccaactctggcctacacttatgaggcatatgttagatacccagaagagtttggaagcaagtcaggcctgtcagaggaagaggttaaaagaaggctaaccgcaagaggccttcttaacatggctgacaagaaggaaactcgctgaaacagcagggactttccacaaggggatgttacggggaggtactggggaggagccggtcgggaacgcccactttcttgatgtataaatatcactgcatttcgctctgtattcagtcgctctgcggagaggctggcaggttgagccctgggaggttctctccagcactagcaggtagagcctgggtgttccctgctagactctcaccagcacttggccggtgctgggcagagtgattccacgcttgcttgcttaaagccctcttcaataaagctgccattttagaagtaagctagtgtgtgttcccatctctcctagccgccgcctggtcaactcggtactcaataataagaagaccctggtctgttaggaccctttctgctttgggaaaccgaagcaggaaaatccctagca

SEQ ID NO: 1217 - DNA, 1565 bp, Influenza A virus
agcaaaagcagggtagataatcactcactgagtgacatcaaaatcatggcgtcccaaggcaccaaacggtcttacgaacagatggagactgatggagaacgccagaatgccactgaaatcagagcatccgtcggaaaaatgattggtggaattggacgattctacatccaaatgtgcaccgaactcaaactcagtgattatgagggacggttgatccaaaacagcttaacaatagagagaatggtgctctctgcttttgacgaaaggagaaataaatacctggaagaacatcccagtgcggggaaagatcctaagaaaactggaggacctatatacaggagagtaaacggaaagtggatgagagaactcatcctttatgacaaagaagaaataaggcgaatctggcgccaagctaataatggtgacgatgcaacggctggtctgactcacatgatgatctggcattccaatttgaatgatgcaacttatcagaggacaagagctcttgttcgcaccggaatggatcccaggatgtgctctctgatgcaaggttcaactctccctaggaggtctggagccgcaggtgctgcagtcaaaggagttggaacaatggtgatggaattggtcaggatgatcaaacgtgggatcaatgatcggaacttctggaggggtgagaatggacgaaaaacaagaattgcttatgaaagaatgtgcaacattctcaaagggaaatttcaaactgctgcacaaaaagcaatgatggatcaagtgagagagagccggaacccagggaatgctgagttcgaagatctcacttttctagcacggtctgcactcatattgagagggtcggttgctcacaagtcctgcctgcctgcctgtgtgtatggacctgccgtagccagtgggtacgactttgaaagagagggatactctctagtcggaatagaccctttcagactgcttcaaaacagccaagtgtacagcctaatcagaccaaatgagaatccagcacacaagagtcaactggtgtggatggcatgccattctgccgcatttgaagatctaagagtattaagcttcatcaaagggacgaaggtgctcccaagagggaagctttccactagaggagttcaaattgcttccaatgaaaatatggagactatggaatcaagtacacttgaactgagaagcaggtactgggccataaggaccagaagtggaggaaacaccaatcaacagagggcatctgcgggccaaatcagcatacaacctacgttctcagtacagagaaatctcccttttgacagaacaaccattatggcagcattcaatgggaatacagagggaagaacatctgacatgaggaccgaaatcataaggatgatggaaagtgcaagaccagaagatgtgtctttccaggggcggggagtcttcgagctctcggacgaaaaggcagcgagcccgatcgtgccttcctttgacatgagtaatgaaggatcttatttcttcggagacaatgcagaggagtacgacaattaaagaaaaatacccttgtttctact

SEQ ID NO: 1218 - DNA, 719 bp, HIV-1
catggatgcaatgaagagagggctctgctgtgtgctgctgctgtgtggagcagtcttcgtttcgcccagcgagatctcctccaagaggtccgtgcccggctggtccaccgtgagggagaggatgaggagggccgagcccgccgccgacagggtgaggaggaccgagcccgccgccgtgggcgtgggcgccgtgtccagggacctggagaagcacggcgccatcacctcctccaacaccgccgccaccaacgccgactgcgcctggctggaggcccaggaggacgaggaggtgggcttccccgtgaggccccaggtgcccctgaggcccatgacctacaagggcgccgtggacctgtcccacttcctgaaggagaagggcggcctggagggcctgatccactcccagaagaggcaggacatcctggacctgtgggtgtaccacacccagggctacttccccgactggcagaactacacccccggccccggcatcaggttccccctgaccttcggctggtgcttcaagctggtgcccgtggagcccgagaaggtggaggaggccaacgagggcgagaacaactgcctgctgcaccccatgtcccagcacggcatcgaggaccccgagaaggaggtgctggagtggaggttcgactccaagctggccttccaccacgtggccagggagctgcaccccgagtactacaaggactgctaaagcc

SEQ ID NO: 1219 - DNA, 671 bp, HIV-1
gatctgccaccatggccggcaagtggtccaagaggtccgtgcccggctggtccaccgtgagggagaggatgaggagggccgagcccgccgccgacagggtgaggaggaccgagcccgccgccgtgggcgtgggcgccgtgtccagggacctggagaagcacggcgccatcacctcctccaacaccgccgccaccaacgccgactgcgcctggctggaggcccaggaggacgaggaggtgggcttccccgtgaggccccaggtgcccctgaggcccatgacctacaagggcgccgtggacctgtcccacttcctgaaggagaagggcggcctggagggcctgatccactcccagaagaggcaggacatcctggacctgtgggtgtaccacacccagggctacttccccgactggcagaactacacccccggccccggcatcaggttccccctgaccttcggctggtgcttcaagctggtgcccgtggagcccgagaaggtggaggaggccaacgagggcgagaacaactgcgccgcccaccccatgtcccagcacggcatcgaggaccccgagaaggaggtgctggagtggaggttcgactccaagctggccttccaccacgtggccagggagctgcaccccgagtactacaaggactgctaaagcccgggc

SEQ ID NO: 1220 - DNA, 720 bp, HIV-1
catggatgcaatgaagagagggctctgctgtgtgctgctgctgtgtggagcagtcttcgtttcgcccagcgagatctcctccaagaggtccgtgcccggctggtccaccgtgagggagaggatgaggagggccgagcccgccgccgacagggtgaggaggaccgagcccgccgccgtgggcgtgggcgccgtgtccagggacctggagaagcacggcgccatcacctcctccaacaccgccgccaccaacgccgactgcgcctggctggaggcccaggaggacgaggaggtgggcttccccgtgaggccccaggtgcccctgaggcccatgacctacaagggcgccgtggacctgtcccacttcctgaaggagaagggcggcctggagggcctgatccactcccagaagaggcaggacatcctggacctgtgggtgtaccacacccagggctacttccccgactggcagaactacacccccggccccggcatcaggttccccctgaccttcggctggtgcttcaagctggtgcccgtggagcccgagaaggtggaggaggccaacgagggcgagaacaactgcgccgcccaccccatgtcccagcacggcatcgaggaccccgagaaggaggtgctggagtggaggttcgactccaagctggccttccaccacgtggccagggagctgcaccccgagtactacaaggactgctaaagccc

SEQ ID NO: 1221 - DNA, 9599 bp, HCV; identical to SEQ ID NO: 631

SEQ ID NO: 1222 - DNA, 340 bp, HCV
ctccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagcc

SEQ ID NO: 1223 - DNA, 340 bp, HCV
ctccacagtcactgagagcgacatccgtacggaggaggcaatttaccaatgttgtgacctggacccccaagcccgcatggccatcaagtccctcactgagaggctttatgtcgggggccctcttaccaattcaaggggggagaactgcggctaccgcaggtgccgcgcgagcggcgtactgacaactagctgtggtaacaccctcacttgctacatcaaggcccgggcagcctgtcgagccgcagggctccaggactgcaccatgcttgtgtgtggcgacgacttagtcgttatctgtgaaagtgcgggggtccaggaggacgcggcgagcctgagagcc

SEQ ID NO: 1224 - DNA, 340 bp, HCV
ctccacagtcactgagagcgacatccgtacggaggaggcaatctaccaatgttgtgatctggacccccaagcccgcgtggccatcaagtccctcactgagaggctttacgttgggggccctcttaccaattcaaggggggagaactgcggctaccgcaggtgccgggcgagcggcgtactgacaactagctgtggtaataccctcacttgctacatcaaggcccgggcagcctgtcgagccgcagggctccgggactgcaccatgctcgtgtgtggtgacgacttggtcgttatctgtgagagtgcgggggtccaggaggacgcggcgagcctgagagcc

SEQ ID NO: 1225 - DNA, 340 bp, HCV
ctctacagtcactgagaacgacatccgtacggaggaggcaatttaccaatgttgtgacctggacccccaagcccgcgtggccatcaagtccctcactgagaggctttatgttgggggcccccttaccaattcaaggggggaaaactgcggctatcgcaggtgccgcgcgagcggcgtactgacaactagctgtggtaacaccctcacttgctacattaaggcccgggcagcctgtcgagccgcagggctccaggactgcaccatgctcgtgtgtggcgacgacttagtcgttatctgtgagagtgcgggagtccaggaggacgcggcgaacttgagagcc

SEQ ID NO: 1226 - DNA, 340 bp, HCV
ctccacagtcactgagagcgatatccgtacggaggaggcaatctaccagtgttgtgacctggacccccaagcccgcgtggccatcaagtccctcaccgagaggctttatgtcgggggccctcttaccaattcaaggggggaaaactgcggctatcgcaggtgccgcgcaagcggcgtactgacaactagctgtggtaacaccctcacttgttacatcaaggcccaagcagcctgtcgagccgcagggctccgggactgcaccatgctcgtgtgtggcgacgacttagtcgttatctgtgaaagtcagggagtccaggaggatgcagcgaacctgagagcc

SEQ ID NO: 1227 - DNA, 340 bp, HCV
ctctacagtcactgagagcgatatccgtacggaggaggcaatctaccaatgttgtgacctggaccccgaagcccgtgtggccatcaagtccctcactgagaggctttatgttgggggccctcttaccaattcaaggggggagaactgcggctaccgcaggtgccgcgcaagcggcgtactgacgactagctgtggtaataccctcacttgttacatcaaggcccgggcagcctgtcgagccgcagggctccaggactgcaccatgctcgtgtgtggcgacgacctagtcgttatctgcgaaagtgcgggggtccaggaggacgcggcgagcctgagagcc

SEQ ID NO: 1228 - DNA, 340 bp, HCV
ctccacagtcactgagaatgacacccgtgttgaggagtcaatttaccaatgttgtgacttggcccccgaagccagacaggccataaggtcgctcacagagcggctctatgtcgggggtcctatgactaactccaaagggcagaactgcggctatcgccggtgccgcgcgagcggcgtgctgacgactagctgcggtaataccctcacatgctacctgaaggccacagcggcctgtcgagctgccaagctccaggactgcacgatgctcgtgaacggagacgaccttgtcgttatctgtgaaagcgcggggaaccaagaggacgcggcaagcctacgagcc

SEQ ID NO: 1229 - DNA, 340 bp, HCV
ctcaacggtcactgagaatgacatccgtgttgaggagtcaatttaccaaagttgtgacttggcccccgaggccagacaagccataaggtcgctcacagagcggctttacatcgggggccccctgactaattcaaaagggcagaactgcggctatcgccgatgccgcgccagcggtgtgctgacgactagctgcggtaataccctcacatgttacttgaaggccactgcggcctgtagagctgcgaagctccaggactgcacgatgctcgtgtgcggagacgaccttgtcgttatctgtgaaagcgcgggaacccaggaggatgcggcgagcctacgagtc

SEQ ID NO: 1230 - DNA, 340 bp, HCV
ctcaacggtcaccgagaatgacatccgtgttgaggagtcaatttatcaatgttgtgccttggcccccgaggctagacaggccataaggtcgctcacagagcggctttatatcgggggccccctgaccaattcaaaggggcagaactgcggttatcgccggtgccgcgccagcggcgtactgacgaccagctgcggtaatacccttacatgttacttgaaggcctctgcagcctgtcgagccgcgaagctccaggactgcacgatgctcgtgtgtggggacgaccttgtcgttatctgtgaaagcgcgggaacccaggaggacgcggcgaacctacgagtc

SEQ ID NO: 1231 - DNA, 340 bp, HCV
ctcaacggtcactgagagtgacatccgtgtcgaggagtcgatttaccaatgttgtgacttggcccccgaagccaggcaggccataaggtcgctcaccgagcgactttatatcgggggccccctgactaattcaaaagggcagaactgcggttatcgccggtgccgcgcgagcggcgtgctgacgactagctgcggtaataccctcacatgttacttgaaggcctctgcagcctgtcgagctgcaaagctccaggactgcacgatgctcgtgaacggggacgaccttgtcgttatctgcgagagcgcgggaacccaagaggacgcggcgagcctacgagtc

SEQ ID NO: 1232 - DNA, 340 bp, HCV
ctccacagtcactgagagtgacatccgtgttgaggagtcaatttaccaatgttgtgacttggcccccgaagccagacaggctataaggtcgctcacagagcggctgtacatcgggggtcccctgactaattcaaaagggcagaactgcggctatcgccggtgccgcgcaagcggcgtgctgacgactagctgcggtaacaccctcacatgttacttgaaggcctctgcggcctgtcgagctgcgaagctccaggactgcacgatgctcgtgtgcggtgacgaccttgtcgttatctgtgagagcgcgggaacccaagaggacgcggcgagcctacgagtc

SEQ ID NO: 1233 - DNA, 340 bp, HCV
ctcaacagtcactgagagtgacatccgtgttgaggagtcaatctaccaatgttgtgacttggcccccgaagccagacaggctataaggtcgctcacagagcggctttacatcgggggtcccctgactaattcaaaagggcagaactgcggctatcgccggtgccgcgcaagcggcgtgctgacgactagctgcggtaataccctcacatgttacctgaaggccagtgcggcctgtcgagctgcgaagctccaggactgcacaatgctcgtgtgcggtgacgaccttgtcgttatctgtgagagcgcggggacccaagaggacgcggcgagcctacgagtc

SEQ ID NO: 1234 - DNA, 340 bp, HCV
ctcaaccgtcactgagagagacatcagaactgaggagtccatataccgagcctgctccctgcctgaggaggctcacattgccatacactcgctgactgagaggctctacgtgggagggcccatgttcaacagcaagggccagacctgcgggtacaggcgttgccgcgccagcggggtgctcaccactagcatggggaacaccatcacatgctatgtaaaagccctagcggcttgcaaggctgcagggatagttgcaccctcaatgctggtatgcggcgacgacttagttgtcatctcagaaagccaggggactgaggaggacgagcggaacctgagagct

SEQ ID NO: 1235 - DNA, 340 bp, HCV
ctctacagtcacgtaaaaggacatcacatcctaggagtccatctaccagtcctgttcactgcccgaggaggctcgaactgctatacactcactgactgagagactatacgtaggggggcccatgacaaacagcaagggccaatcctgcgggtacaggcgttgccgcgcgagcgcagtgctcaccaccagcatgggcaacacactcacgtgctacgtaaaagccagggcggcgtgtaacgccgcggggattgttgctcccaccatgctggtgtgcggtgacgacctggtcgtcatctcagagagtcaaggggctgaggaggacgagcagaacctgagagtc

SEQ ID NO: 1236 - DNA, 340 bp, HCV
ctctacagtcacagagagggacatcagaaccgaggagtccatctatctgtcctgctcactgcctgaggaggcccgaactgctatacactcactgactgagagactgtacgtaggggggcccatgacaaacagcaaggggcaatcctgcgggtacaggcgttgccgcgcgagcggagtgctcaccaccagcatgggcaacacgctcacgtgctacgtgaaagccagagcggcgtgtaacgccgcgggcattgttgctcccaccatgttggtgtgcggcgacgacctggttgtcatctcagagagtcagggggtcgaggaagatgagcggaacctgagagtc

SEQ ID NO: 1237 - DNA, 340 bp, HCV
ctctacagtcacggagagggacatcagaaccgaggagtccatctatctgtcctgttcactgcctgaggaggctcgaactgccatacactcactgactgagaggctgtacgtaggggggcccatgacaaacagcaaagggcaatcctgcgggtacaggcgttgccgcgcgagcggagtgctcaccaccagcatgggtaacacactcacgtgctacgtgaaagctaaagcggcatgtaacgccgcgggcattgttgcccccaccatgttggtgtgcggcgacgacctagtcgtcatctcagagagtcaaggggtcgaggaggatgagcgaaacctgagagct

SEQ ID NO: 1238 - DNA, 340 bp, HCV
ctcaaccgtcacggagagggacataagaacagaagaatccatatatcagggttgttccctgcctcaggaggctagaactgctatccactcgctcactgagagactctacgtaggagggcccatgacaaacagcaagggacaatcctgcggttacaggcgttgccgcgccagcggggtcttcaccaccagcatggggaataccatgacatgctacatcaaagcccttgcagcgtgcaaagctgcagggatcgtggaccctatcatgctggtgtgtggagacgacctggtcgtcatctcggagagcgaaggtaacgaggaggacgagcgaaacctgagagct

SEQ ID NO: 1239 - DNA, 340 bp, HCV
ctcgaccgttaccgaacatgacataatgactgaagagtctatttaccaatcattgtacttgcagcctgaggcgcgtgtggcaatacggtcactcacccaacgcctgtactgtggaggccccatgtataacagcaaggggcaacaatgtggttatcgtagatgccgcgccagcggcgtcttcaccactagtatgggcaacaccatgacgtgctacattaaggctttagcctcctgtagagccgcaaagctccaggactgcacgctcctggtgtgtggtgatgatcttgtggccatttgcgagagccaggggacgcacgaggataaagcgagcctgagagcc

SEQ ID NO: 1240 - DNA, 340 bp, HCV
ctcgaccgttaccgaacatgacataatgactgaagagtccatttaccaatcattgtacttgcagcctgaggcacgcgcggcaatacggtcactcacccaacgcctgtactgtggaggccccatgtataacagcaaggggcaacaatgtggttaccgtagatgccgcgccagcggcgtcttcaccaccagtatgggcaacaccatgacgtgctacatcaaggcttcagccgcctgtagagctgcaaagctccaggactgcacgctcctggtgtgtggtgtgaccttggtggccatttgcgagagccaagggacgcacgaggatgaagcgtgcctgagagtc

SEQ ID NO: 1241 - DNA, 340 bp, HCV
ctctactgtcactgaacaggacatcagggtggaagaggagatataccagtgctgtaaccttgaaccggaggccaggaaagtgatctcctccctcacggagcggctttactgcgggggccctatgttcaacagcaagggggcccagtgtggttatcgccgttgccgtgctagtggagtcctgcctaccagcttcggcaacacaatcacttgttacatcaaggctagagcggcttcgaaggccgcaggcctccggaacccggactttcttgtctgcggagatgatctggtcgtggtggctgagagtgatggcgtcgacgaggatagagcagccctgagagcc

SEQ ID NO: 1242 - DNA, 340 bp, HCV
ctcgactgtcactgaacaggacatcagggtggaagaggagatataccaatgctgtaaccttgaaccggaggccaggaaagtgatctcctccctcacggagcggctttactgcgggggccctatgttcaatagcaagggggcccagtgtggttatcgccgttgccgtgctagtggagttctgcctaccagcttcggcaacacaatcacttgttacatcaaggctagagcggctgcgaaggccgcagggctccggaccccggactttctcgtctgcggagatgatctggttgtggtggctgagagtgatggcgtcgacgaggatagaacagccctgcgagcc

SEQ ID NO: 1243 - DNA, 340 bp, HCV
ctcaactgtcactgaacaggacatcagggtggaagaggagatataccaatgctgtaaccttgaaccggaggccaggaaagtgatctcctccctcacggaacggctttactgcgggggccctatgttcaacagcaagggggcccagtgtggttatcgccgttgccgtgccagtggagttctgcctaccagcttcggcaacacaatcacttgttacatcaaagctagagcggctgccgaagccgcaggcctccggaacccggactttcttgtctgcggagatgatctggttgtggtggctgagagtgatggcgtcaatgaggatagagcagccctgggagcc

SEQ ID NO: 1244 - DNA, 100 bp, HCV
gacggcgttggtaatggctcagctgctccggatcccacaagccatcttggacatgatcgctggtgctcactggggagtcctggcgggcatagcgtatttc

SEQ ID NO: 1245 - DNA, 100 bp, HCV
gacggcgttggtggtagctcaggtactccggatcccacaagccatcatggacatgatcgctggagcccactggggagtcctggcgggcatagcgtatttc

SEQ ID NO: 1246 - DNA, 100 bp, HCV
aacggcgctggtagtagctcagctgctcagggtcccgcaagccatcgtggacatgatcgctggtgcccactggggagtcctagcgggcatagcgtatttt

SEQ ID NO: 1247 - DNA, 100 bp, HCV
gacagccctagtggtatcgcagttactccggatcccacaagccgtcatggatatggtggcgggggcccactggggagtcctggcgggccttgcctactat

SEQ ID NO: 1248 - DNA, 100 bp, HCV
agcagccctagtggtgtcgcagttactccggatcccacaaagcatcgtggacatggtggcgggggcccactggggagtcctggcgggccttgcttactat

SEQ ID NO: 1249 - DNA, 100 bp, HCV
ggcagccctagtggtgtcgcagttactccggatcccgcaagctgtcgtggacatggtggcgggggcccactggggaatcctagcgggtcttgcctactat

SEQ ID NO: 1250 - DNA, 100 bp, HCV
tgtgggtatggtggtggcgcacgtcctgcgtttgccccagaccttgttcgacataatagccggggcccattggggcatcttggcgggcttggcctattac

SEQ ID NO: 1251 - DNA, 100 bp, HCV
tgtgggtatggtggtagcacacgtcctgcgtctgccccagaccttgttcgacataatagccggggcccattggggcatcttggcaggcctagcctattac

SEQ ID NO: 1252 - DNA, 100 bp, HCV
tgtgggtatggtggtggcgcaagtcctgcgtttgccccagaccttgttcgacgtgctagccggggcccattggggcatcttggcgggcctggcctattac

SEQ ID NO: 1253 - DNA, 100 bp, HCV
taccactatgctcctggcatacttggtgcgcatcccggaggtcatcctggacattatcacgggaggacactggggcgtgatgtttggcctggcttatttc

SEQ ID NO: 1254 - DNA, 252 bp, HCV
gttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcacc

SEQ ID NO: 1255 - DNA, 252 bp, HCV; identical to SEQ ID NO: 1254

SEQ ID NO: 1256 - DNA, 252 bp, HCV
gttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcacgcccccgcaagatcactagccgagtagtgttgggtcgcgaaaggccttgtggtactgcctgatagggtgcttgcgagtgccccgggaggtctcgtagaccgtgcacc

SEQ ID NO: 1257 - DNA, 252 bp, HCV
gttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcacc

SEQ ID NO: 1258 - DNA, 252 bp, HCV; identical to SEQ ID NO: 1254

SEQ ID NO: 1259 - DNA, 252 bp, HCV
gttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcacc

SEQ ID NO: 1260 - DNA, 252 bp, HCV
gttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcacc

SEQ ID NO: 1261 - DNA, 252 bp, HCV
gttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatc

SEQ ID NO: 1262 - DNA, 252 bp, HCV; identical to SEQ ID NO: 1260

SEQ ID NO: 1263 - DNA, 252 bp, HCV; identical to SEQ ID NO: 1260

SEQ ID NO: 1264 - DNA, 252 bp, HCV; identical to SEQ ID NO: 1260

SEQ ID NO: 1265 - DNA, 252 bp, HCV; identical to SEQ ID NO: 1260

SEQ ID NO: 1266 - DNA, 252 bp, HCV; identical to SEQ ID NO: 1260

SEQ ID NO: 1267 - DNA, 252 bp, HCV
gctagtatcagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatc

SEQ ID NO: 1268 - DNA, 252 bp, HCV
gttagtatgagtctcgtacagcctccaggcccccccctcccgggagagccatagtggtctgcggaaccggtgagtacaccggaattgctgggaagactgggtcctttcttggataaacccactctatgcccagccatttgggcgtgcccccgcaagactgctagccgagtagcgttgggttgcgaaaggccttgtggtactgcctgatagggtgcttgcgagtgccccgggaggtctcgtagaccgtgcatc

SEQ ID NO: 1269 - DNA, 252 bp, HCV
gttagtacgagtgtcgtgcagcctccaggactccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaac

SEQ ID NO: 1270 - DNA, 252 bp, HCV
gttagtacgagtgtcgtgcagcctccaggaccccccctcccgggagagccatagtggtctgcggaaccggtgagtacaccggaatcgctggggtgaccgggtcctttcttggagtaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaac

SEQ ID NO: 1271 - DNA, 180 bp, HCV
gttagtatgagtgtcgaacagcctccaggaccccccctcccgggagagccatagtggtctgcggaaccggtgagtacaccggaattgccgggatgaccgggtcctttcttggataaacccgctcaatgcccggagatttgggcgtgcccccgcgagactgctagccgagtagtgttgggt

SEQ ID NO: 1272 - DNA, 180 bp, HCV; identical to SEQ ID NO: 1271

SEQ ID NO: 1273 - DNA, 549 bp, HCV
atgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctct

SEQ ID NO: 1274 - DNA, 549 bp, HCV
atgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagttggggccccacagacccccggcgtaggtcgcgcaatttgggtaaggtcatcgatacccttacgtgcggcttcgccgaccacatggggtacataccgctcgtcggcgcccctcttggaggcgctgccagggctctggcgcatggcgtccgggttctggaagacggcgtgaactatgcaacagggaaccttcctggttgctctttctctatcttccttctggccctgctctct

SEQ ID NO: 1275 - DNA, 549 bp, HCV
atgagcacgaatcctaaacctcaaagaaaaaccaaacgtaacaccaaccgtcgcccacaggacgttaagttcccgggtggcggtcagatcgttggtggagtttacttgttgccgcgcaggggccctagattgggtgtgcgcgcgacgaggaagacttccgagcggtcgcaacctcgaggtagacgtcagcctatccctaaggcgcgtcggcccgagggcaggacctgggctcagcccgggtacccctggcccctctatggtaatgagggttgcggatgggcgggatggctcctgtccccccgtggctctcggcctagttggggccctacagacccccggcgtaggtcgcgcaatttgggtaaggtcatcgataccctcacgtgcggcttcgccgaccacatggggtacattccgctcgttggcgcccctcttgggggcgctgccagggccctggcgcatggcgtccgggttctggaagacggcgtgaactatgcaacagggaatcttcctggttgctctttctctatcttccttctggcccttctctct

SEQ ID NO: 1276 - DNA, 549 bp, HCV
atgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcacgacgaggaagacttccgagcggtcgcaacctcgaggtagacgtcagcccatccccaaggctcgtcgacccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagagccctggcgcatggcgtccgggttctggaagacggcgtgaactatgcaacagggaaccttcccggttgctctttctctatcttccttctggccctgctctct

SEQ ID NO: 1277 - DNA, 549 bp, HCV
atgagcacgaatcctaaacctcaaagaagaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggtaggacctgggctcagcccgggtacccttggcccctctatggcaatgagggttgcgggtgggcgggatggctcctgtctccccgcggctctcggcctaactggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctct

SEQ ID NO: 1278 - DNA, 549 bp, HCV
atgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgtggtagacgccagcctatccccaaggcgcgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttttctattttccttctggccctgctctct

SEQ ID NO: 1279 - DNA, 549 bp, HCV
atgagcacgaatcctaaacctcaaagaaaaaccaaacgtaacaccaaccgccgcccacaggacgttaagttcccgggcggtggccaggtcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggtatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgccccccttaggggcgctgccagggccttggcgcatggcgtccgggttctggaggacggcgtgaactacgcaacagggaatctgcccggttgctccttttctatcttcctcttggctctgctgtcc

SEQ ID NO: 1280 - DNA, 549 bp, HCV
atgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaacgagggtatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgcttgtcggcgcccccctagggggcgctgccagggccctggcacatggtgtccgggttctggaggacggcgtgaactatgcaacagggaatttgcccggttgctctttctctatcttcctcttggctctgctgtcc

SEQ ID NO: 1281 - DNA, 549 bp, HCV
atgagcacaaatcctaaaccccaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggtcctgggctcagcccgggtacccttggcccctctatggcaacgagggtatggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaggacggcgtgaactatgcaacagggaatttgcctggttgctctttctctatcttcctcttggctctgctgtcc

SEQ ID NO: 1282 - DNA, 549 bp, HCV
atgagcacgaatcctaaacctcaaagaaaaaccaaacgtaacaccaaccgccgcccacaggacgtcaagttcccgggcggtggtcagatcgttggtggagtttacttgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccttggcccctctatggcaatgagggtatggggtgggcagggtggctcctgtccccccgcggctcccggcctagttggggccccacagacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggttctggaggacggcgtgaactatgcaacagggaatctgcccggttgctctttctctatcttcctcttggctttgctgtcc

SEQ ID NO: 1283 - DNA, 549 bp, HCV
atgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtatccttggcccctctatggcaatgagggtctggggtgggcaggatggctcctgtcaccccgcggctctcggcctagctggggccctaccgacccccggcgtaggtcgcgcaacttgggtaaggtcatcgatacccttacgtgcggcttcgccgacctcatggggtacattccgctcgtcggcgccccccttaggggcgctgccagggccctggcgcatggcgtccgggttctggaggacggcgtgaactatgcaacagggaatttgcccggttgctctttctctatcttcctcttggctttgctgtcc

SEQ ID NO: 1284 - DNA, 549 bp, HCV
atgagcacgaatcctaaacctcaaagaaaaaccaaacgtaacaccaaccgccgcccacaggacgtcaagttcccgggcggtggtcagatcgttggtggagtttacttgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccttggcccctctatggcaatgagggtatggggtgggcaggatggctcctgtcaccccgtggttctcggcctagttggggccccacggacccccggcgtaggtcgcgcaatttgggtaagatcatcgataccctcacgtgcggcttcgccgacctcatggggtacattccgctcgtcggcgcccccctagggggcgctgccagggccctggcgcatggcgtccgggttctggaggacggcgtgaactatgcaacagggaatctgcccggttgctccttttctatcttccttctggctttgctgtcc

SEQ ID NO: 1285 - DNA, 549 bp, HCV
atgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccctggcccctctatggcaatgagggtatggggtgggcaggatggctcctgtcaccccgcggctcccggcctagttggggccccaaagacccccggcgtaggtcgcgtaatttgggtaaggtcatcgataccctcacatgcggcttcgccgacctcatggggtacattccgctcgtcggcgcccccttagggggcgctgccagggccctggcgcatggcgtccgggttctggaggacggcgtgaactatgcaacagggaatctacccggttgctctttctctatcttcctcttggctttgctgtcc

SEQ ID NO: 1286 - DNA, 549 bp, HCV
atgagcacaaatcctaaacctcaaagaaaaaccaaaagaaacactaaccgccgcccacaggacgtcaagttcccgggcggtggccagatcgttggcggagtatacttgctgccgcgcaggggcccgagattgggtgtgcgcgcgacgaggaaaacttccgaacgatcccagccacgcggaaggcgtcagcccatccctaaagatcgtcgcaccgctggcaagtcctggggaaggccaggatatccttggcccctgtatgggaatgagggtctcggctgggcagggtggctcctgtccccccgtggctctcgcccttcatggggccccactgacccccggcatagatcgcgcaacttgggtaaggtcatcgataccctaacgtgcggttttgccgacctcatggggtacattcccgtcatcggcgcccccgttggaggcgttgccagagctctcgcccacggagtgagggttctggaggatggggtaaattatgcaacagggaatttgcccggttgctctttctctatctttctcttagccctcttgtct

SEQ ID NO: 1287 - DNA, 510 bp, HCV
atgagcacaaatcctcaacctcaaagaaaaaccaaaagaaacactaaccgccgcccacaggacgtcaagttcccgggcggtggtcagatcgttggcggagtatacttgttgccgcgcaggggccccaggttgggtgtgcgcgcgacgaggaaaacttccgaacggtcccagccacgtgggaggcgccagcccatccccaaagatcggcgcaccactggcaagtcctgggggaagccaggatacccttggcccctgtatgggaatgagggtctcggctgggcagggtggctcctgtccccccgcggttctcgcccttcatggggccccactgacccccggcatagatcacgcaacttgggtaaggtcatcgataccctaacgtgtggttttgccgacctcatggggtacattcccgtcggtggtgcccccgttggtggtgtcgccagagcccttgcccatggggtgagggttctggaagacgggataaattatgcaacagggaatctgccc

SEQ ID NO: 1288 - protein, 191 aa, HCV
MSTNPKPQRKTKRNTNRRPQDVKFPGGGQIVGGVYLLPRRGPRLGVRATRKTSERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASA

SEQ ID NO: 1289 - protein, 632 aa, HCV
MAPITAYSQQTRGLLGCTITSLTGRDKNQVEGEVQVVSTATQSFLATCINGVCWTVYHGAGSKTLAGPKGPITQMYTNVDQDLVGWQAPPGARSMTPCTCGSSDLYLVTRHADVIPVRRRGDSRGSLLSPRPVSYLKGSVGGPLLCPSGHVVGIFRAAVCTRGVAKAVDFIPVESMETTMRSPVFTDNSSPPAVPQTFQVAHLHAPTGSGKSTKVPAAYAAQGYKVLVLNPSVAATLGFGAYMSKAHGIDPNIRTGVRTITTGAPITYSTYGKFLADGGCSGGAYDIIICQECHSTDSTTILGIGTVLDQAETAGARLVVLATATPPGSVTVPHPNIEEVALSNNGEIPFYGKAIPIEAIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRSGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVT

SEQ ID NO: 1290 - protein, 214 aa, HCV
MFWAKHMWNFISGIQYLAGLSTLPGNPAIASLMAFTASITSPLTTQNTLLFNILGGWVAAQLAPPSAASAFVGAGIAGAAVGSIGLGKVLVDILAGYGAGVAGALVAFKVMSGEVPSTEDLVNLLPAILSPGALVVGVVCAAILRRHVGPGEGAVQWMNRLIAFASRGNHVSPTHYVPESDAAARVTQILSSLTITQLLKRLHQWINEDCSTPC

SEQ ID NO: 1291 - protein, 591 aa, HCV
MSMSYTWTGALITPCAAEESKLPINPLSNSLLRHHNMVYATTSRSASLRQKKVTFDRLQVLDDHYRDVLKEMKAKASTVKAKLLSIEEACKLTPPHSAKSKFGYGAKDVRNLSSRAVNHIRSVWEDLLEDTETPIDTTIMAKSEVFCVQPEKGGRKPARLNFPDLGVRVCEKMALYDVVSTLPQAVMGSSYGFQYSPKQRVEFLVNTWKSKKCPMGFSYGTRCFGSTVTESDIRVEESIYQCCDLAPEARQAIRSLTERLYIGGPLTNSKGQNCGYRRCRASGVLTTSCGNTLTCYLKATAACRAAKLQDCTMLVNGDDLVVICESAGTQEDAAALRAFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIERLHGLSAFSLHSYSPGEINRVASCLRKLGVPPLRVWRHRARSVRAKLLSQGGRAATCGRYLFNWAVRTKLKLTPIPAASQLDLSGWFVAGYSGGDIYHSLSRARPRWFPLCLLLLSVGVGIYLLPNR

SEQ ID NO: 1292 - DNA, 3651 bp, Seol Hantavirus (SEOV)
tagtagtagactccgcaagaaacagcagttaaagaacaataggatcatgtggagtttgctattactggccgctttagttggccaaggctttgcattaaaaaatgtatttgacatgagaattcagttgccccactcagtcaactttggggaaacaagtgtgtcaggctatacagaatttcccccactctcattacaggaggcagaacagctagtgccagagagctcatgcaacatggacaaccaccagtcactctcaacaataaataaattaaccaaggtcatatggcggaaaaaagcaaatcaggaatcagcaaaccagaattcatttgaagttgtggaaagtgaagtcagctttaaagggttgtgtatgttaaagcatagaatggttgaagaatcatatagaaataggagatcagtaatctgttatgatctagcctgtaatagtacattctgtaaaccaactgtttatatgattgttcctatacatgcttgcaacatgatgaaaagctgtttgattggccttggcccctacagaatccaggttgtctatgaaaggacatactgcactacgggtatattgacagaaggaaaatgctttgtccctgacaaggctgttgtcagtgcattgaaaagaggcatgtatgctatagcaagcatagagacaatctgcttttttattcatcagaaagggaatacatataagatagtgactgccattacatcagcaatgggctccaaatgtaataatacagatactaaagttcaaggatattatatctgtattattggtggaaactccgcccctgtatatgcccctgctggtgaagacttcagagcaatggaggttttttctgggattattacatcaccacatggagaagaccatgacctacccggcgaagaaatcgcaacgtaccagatttcagggcagatagaggcaaaaatccctcatacagtgagctccaaaaacttaaaattgactgcttttgcaggtattccatcatactcatcaactagtatattggctgcttcagaagatggtcgtttcatatttagtcctggtttatttcctaacctaaatcagtcagtctgtgacaacaatgcactccctttaatctggaggggcctaattgatttaacgggatactatgaggcagtccacccttgcaatgtgttctgtgtcttatcaggaccaggtgcttcatgtgaggccttttcagaaggaggtaggggcaatattacttctccaatgtgtctggtgtctaagcaaaatagatttagagcagctgagcagcagattagctttgtctgccaaagagttgatatggatattatagtgtactgtaatggtcagaaaaaaacaatcctaacaaaaacattagttataggccaatgtatttatactattacaagtctcttttcactgttaccaggggttgcccattctattgctattgagttgtgtgttccagggtttcatggctgggccacagctgcacttttgattacattctgcttcggctgggtattgattcctgcatgtacattagctattcttttagtccttaagttctttgcaaatatccttcatacaagcaatcaagagaaccgattcaaagccattctacggaaaataaaggaggagtttgaaaaaacaaagggttccatggtttgtgagatctgtaagtatgagtgtgaaacattaaaggaattgaaggcacataacctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacactaaatctttttaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacggatcttgaattagacttctctttgccatccagttctaagtacacatacaaaagacatctcacaaacccagttaatgaccaacagagtgtctcattgcatatagaaattgaaagtcaaggcattggtgctgctgttcatcatcttggacattggtatgatgcaagattgaatctaaaaacctcatttcattgttatggtgcctgcacaaaatatcaatacccatggcacactgcaaaatgccattttgagaaagattatgagtatgaaaatagctgggcttgcaaccccccagattgcccaggggttggtacaggttgtactgcttgtggattatatctagatcaattgaagccggtaggaacagcctttaaaattataagtgtaagatacagtagaaaagtgtgcgtgcagtttggtgaagaacacctttgtaaaacaattgatatgaatgattgctttgtgactaggcatgccaaaatatgtataattgggactgtatctaagttttctcaaggtgacactctactatttctggggcccatggaaggaggtggtataatctttaaacactggtgtacatctacctgtcactttggagaccctggtgatgtcatgggtccaaaagataaaccatttatttgccctgaatttccagggcaatttaggaaaaaatgtaactttgccacaactccagtttgtgaatatgatggaaacattatatcaggctataagaaagtacttgcaacaattgattctttccaatcatttaacacaagcaatatacacttcactgatgagagaattgaatggagagaccctgatggcatgcttcgggatcatattaatattgttatttctaaagatattgattttgaaaatttggctgagaatccttgtaaagtagggctccaggcagcaaacatagaaggtgcctggggttcaggtgtcgggtttacactcacatgcaaggtgtctctcacagaatgcccaacatttcttacatcaataaaggcctgtgacatggcaatttgttatggtgcagaaagtgtgacactctcacgaggacaaaatactgtcaaaattaccgggaaaggtggccatagtggttcttcattcaaatgctgtcatgggaaagaatgttcatcaactggcctccaagccagtgcaccacatctggataaggtaaatggtatctctgagttagaaaacgagaaagtttatgatgacggtgcacctgaatgtggcattacttgttggtttaaaaaatcaggtgaatgggttatgggtataatcaatgggaactgggttgtcctaattgtcttgtgtgtactgctgctcttttctcttatcctgttgagcatcttgtgtcctgttagaaagcataaaaaatcataaatcccacctaacaatcttcacatcatgtatcgattttcaaacactttatcatttagaacttaacttggcactactatctgataactgactttcatttttatttttatatggattaattactaaaaaaaatactctcttctatctcccaatcttttattgattcaccggggtgctgtcttgacatctggcggcgtctactacta

SEQ ID NO: 1293 - DNA, 1769 bp, Seol Hantavirus (SEOV)
tagtagtagactccctaaagagctactacactaacaagaaaaatggcaactatggaagaaatccagagagaaatcactgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacagattgcagcagggaagaacatccgggcaggaccgggatcctacaggggtagagccaggtgatcatcttaaggaaagatcagcactaagctacgggaatacactggacctgaatagtcttgacattgatgaacctacaggacagacagctgattggctgaccataattgtctatctgacatcattcgtggtcccgatcatcttgaaggcactgtacatgttaacaacacgaggtaggcagacttcaaaggacaacaaggggatgaggatcagattcaaggatgacagctcatatgaggatgtcaatggaatcagaaagcccaaacatctgtatgtgtcaatgccaaacgcccaatccagcatgaaggctgaagagataacaccaggaagattccgcactgcagtatgtggactatatcctgcacagataaaggcaaggaatatggtaagccctgtcatgagtgtagttgggttcttggcactggcaaaagactggacatcgagaattgaagaatggctcggtgcaccctgcaaattcatggcggagtctcttattgccgggagtttatctgggaatcctgtgaatcgtgactatatcagacagagacaaggtgcacttgcagggatggagccaaaggaatttcaagccctcaggcaacattcaaaggatgctggatgtacactagttgaacatattgagtcaccatcatcaatatgggtgtttgctggggcccctgataggtgtccaccaacatgcttgtttgtcggagggatggctgaattaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcttgattgaccagaaagtgaaggaaatctcaaaccaggaacctatgaaattataagtacataaatatataatcaatactaactataggttaagaaatactaatcattagttaataagaatatagatttattgaataatcatattaaataattaggtaagttaactagtatttagttaagttagctaattgatttatatgattgtcacaattaaatgtaatcataagcacaatcactgccatgtataatcacgggtatacgggtggttttcatatggggaacagggtgggcttagggccaggtcaccttaagtgacctttttttgtatatatggatgtagatttcaattgatcgaatactaatcctactgtcctcttttcttttcctttctccttctttactaacaacaacaaactacctcacaccttaatatatactactttattaagttgttaagttgtgtctttttggggagtaagggagtctactacta

SEQ ID NO: 1294 - protein, 3011 aa, HCV-1
MSTNPKPQKKNKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLARGGRAAICGKYLFNWAVRTKLKLTPIAAAGQLDLSGWFTAGYSGGDIYHSVSHARPRWIWFCLLLLAAGVGIYLLPNR

SEQ ID NO: 1295 - protein, 363 aa, HCV-1
ETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEA

SEQ ID NO: 1296 - protein, 366 aa, HCV-1
ETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALE

SEQ ID NO: 1297 - protein, 426 aa, HCV-1
ETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYA

SEQ ID NO: 1298 - protein, 555 aa, HCV-1
YQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEA

SEQ ID NO: 1299 - protein, 558 aa, HCV-1
YQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALE

SEQ ID NO: 1300 - protein, 618 aa, HCV-1
YQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYA

SEQ ID NO: 1301 - protein, 211 aa, HBV-1
MQLFHLCLIISCSCPTVQASKLCLGWLDMDIDPYKEFGATVELLSFLPSDFFPSVRDLLDTASALYREALESPEHCSPHHTALRQAILCWGDLITLSTWVGGNLEDPTSRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRTQSRESQC

SEQ ID NO: 1302 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 1303 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAKKVRRAIEQLAAMD

SEQ ID NO: 1304 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 1305 - protein, 280 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 1306 - DNA, 750 bp, HCV
caactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgag

SEQ ID NO: 1307 - DNA, 2359 bp, Murine rotavirus
ggctataaaatggcttcactcatttatagacaactgctcacgaattcctttaccgtacatatatctgatgaaattgaaactattggagcagagaagacacaaaatgttacagtgaatcccggtccattcgcgcaaacgggatacgccccagcaaactgggggccaggcgaaactaacgactcaacaacagtagaaccaatgcttgatggaccataccaaccaatagcgttcagtccgccgccagagtactatatcatcctctccccgactgcacccggagtaatcgctgaatgtacgaatactgtcaaccgctggatagcaatcatagctatagagccaaacgtgtcaacaacaaatcgtacctacacattgttcggaattactgaacagctaacagtagaaaacagctccgtggataaatggaagtttatagacttcatgaaaactccaacaactggcagctacgtccgttataacattttgttgtctagcactaagctatgcgcagtggcgaacgacacggacaatttatactcctatgttggagaaacgcctactgcaggtcaggcatactactcttctttcaatatatttaacctaaccgcgcactgtgacttctacattataccatggtcgcagcaatcgttgtgcacgcaatacgttaataacggattaccgccgatccagaatacaagaaatgtagtgccaagacatctgtcagcgagatcaatcatcacacaaagagcgcaacagaatgaagacattgttgtgtcaaagacatccttatggaaagaaatgcagtttaatagggacataacaatacgtttcaaattcgcgaatgcaataataaagtctggcggcttgggatataattggtcagagatctctttcaaaccagcgaactaccaatacacgtacacacgtgatggtgaagaagtaactgcgcatactacgtgctcggtaaacggtgtgaacaacttcgatttctttggcggtacgctccctacggatttcggtatttcgcggtacgaagtgattaaggagaattcattcgtgtacatagactattgggacgactctcaggctttcagaaatatggtctatgtgcgctcactagcggctgatttgaacactgtcgaatgcactgggggggcgtacagcttttcactaccagttgggcaatggccggtgatgacgggtggtgcagtgtctttgcgagctgccggagttacactatctacacagttcacagacttcgtgtcgctaaattcgttgagatttaggtttcgtttgtcagtggaagaaccgtcattcagtataacgagaacaagagtgtcagggctatacggcttgccagagcgggatcctaacaacggcagagaatattacgaaattgcaggtagattttcgttaatatcattagtgccgtccaacgataactatcaaacaccgataatgaattcagttacggtgcggcaagatctggagagacagctaggcgaactacgacgagaattcaacgcgctgtcgcaggaaatagcgctgtcacagttggtggatttagcgctactgccattagatatgttctcaatgttttcaggcatcaaagcaacgctcgacgtggcaaagtcaatggcaacgaacgtgatgaaaaaattcaaaaaatcgggactggccacgtcgatttcacgcatgactgagtcactatcagatgcagcttcctcagtgtctcggagtgagctgcatacgctcagtcagttccacgtcatcagcttggacagacgtttcgtagctgctgtggccaacgtggaaaatgccgcctcaacagtttcaacacagacggccacaatcagcagacggttgagactgaaggaaatcacaacgcagactgaaggcatgaacttcgatgacatctcagccgctgtacttaaaactaagcttgataaatcagtacgaatcgcgccgaacacgctaccagacatagtaacagaagcgtcagagaagttcattccgaacagatcatacagagttataaacaacaatgaagcattcgaaactggaactgacggacgcttcttcgcataccgagttgacactcttgaggaactgccattcgacgttcagaaattcgcatgccatgctgcagagtccccagtaatctcagccatcactgacttcaagactttgaaaaatttgaacgataactacggaatctcgaaagaacaggccttcagtttattacgctcagatccgcgagtactccgtgaatttattaatcaggggaatccaataatacgtaatagaatagaacagttaattatgcagtgtagactgtgagcagtgtctagaggatgtgacc

SEQ ID NO: 1308 - DNA, 1356 bp, human rotavirus
ggctttaaaacgaagtcttcgacatggaggttctgtattcattgtcaaaaactcttaaagatgctagggataagattgttgaaggtacattatattctaatgttagtgatctcattcagcaatttaatcaaatgatagtaaccatgaatggaaatgactttcaaactggaggaattggcaatttacctattagaaattggacatttgactttggtctactaggtactacgctgttaaaccttgatgctaattacgttgagactgcaagaactacaattaagtattttattgactttattgataatgtatgtatggatgaaatggcaagagagtctcaaagaaatggagtagctccacaatctgaggcattgaggaagctagccggtattaaatttaaaagaataaattttaataattcatcagaatatatagaaaattggaatttacaaaatagaagacagcgtaccggatttgttttccataaacctaatatatttccatactcagcatcatttactttaaataggtctcaaccaatgcatgacaatttaatgggaaccatgtggcttaacgctggatcagaaattcaagtggctggatttgactactcgtgtgccctaaatgctccagcaaatattcagcagtttgaacatattgtccagcttaggcgtgcgctaactacagctactataactttgctacctgatgcagaaagatttagttttccaagagttattaattcagcagatggcgcaaccacatggttctttaatccaattatcctaagaccaaacaatgtagaggtagaatttttactgaatggacaaattattaatacatatcaagctagatttggaactattatcgcaagaaattttgatacaattcgtctatcattccaattaatgcgtccaccaaacatgacgccagccgtaaatgcattatttccgcaagcacaaccttttcaacatcatgcaacagttggacttacgttacgtattgagtctgcagtttgtgaatcagtgcttgcggatgcaaatgaaactttattggcgaatgttactgcagtacgtcaagagtatgctataggcgttggaccagtatttccaccaggcatgaattggactgagctgattactaactattcaccatccagggaagataatttgcaacgtgtctttacagtagcctctatcagaagcatgttaattaagtgaggaccagactaaccatctggtatccaatcttaattagcatgtagctatgtcaagtcattcagactctacaagtaaggacatgatttcatgttcgctacgtagagtaactgcatgaatgatctagtgagaggatgtgacc

SEQ ID NO: 1309 - DNA, 1356 bp, Bovine rotavirus
ggcttttaaacgaagtcttcaacatggatgtcctgtactccttgtcaaaaactcttaaagatgctagagacaaaattgtcgaaggcacattatactccaatgtaagtgatctaattcaacaatttaatcaaatgataattactatgaatggaaatgagttccaaactggaggaattggtaatctaccgattagaaattggaattttgattttggattactcggaacaactctactaaatttggatgccaactacgtcgaaacggcccgcaatacaattgattattttgtagattttgtagataatgtatgtatggatgaaatggttagagaatcacaaagaaatggaattgcaccacaatcagattcacttagaaagttgtcaggtattaaattcaaaagaataaattttgacaattcatcagaatacatagagaactggaatttgcaaaacagaagacaaagaacgggttttacatttcataaaccaaacattttcccttactcagcgtcattcacactgaacagatcacaaccagctcatgataacttgatgggtacgatgtggctcaatgcgggatcagaaattcaggtcgctggattcgattattcatgtgcaatcaatgcgccagccaatacacaacaatttgagcatattgtacagctccgaagagtgttgactacagctacaataactcttttaccagatgcagaaagatttagttttccaagagtgattaattcagctgacggagctactacatggtacttcaacccagtgattcttagaccaaataacgttgaagtagagtttctactaaacgggcagataataaatacttaccaagcaagatttggaacgatcatagctagaaattttgatacaattagattgtcatttcagttgatgagaccaccaaatatgacaccagcggtagcggcgttatttccaaatgcgcagccatttgaacatcaggcaacagtaggactcacgcttagaattgaatctgcagtttgtgaatcagtgcttgccgacgcaagtgaaacaatgctagcaaatgtgacatctgttagacaagaatacgcgataccagttggaccagtttttccaccaggtatgaattggactgatttgatcactaactattcaccatctagagaggataatttgcagcgtgtatttacagtggcttccattagaagcatgcttgtcaaatgaggaccaagctaaccacttggtatccgactttggtgagtatgtagctacgtcaagctgtttgaactctgtaagtaaggatgcgtctacgtattcgctacacagagtaatcactcagatggcgtagtgagaggatgtgacc

SEQ ID NO: 1310 - DNA, 1061 bp, Murine rotavirus
ggctttaaaagagagaatttccgtttggctagcggttagctccttttaatgtatggtattgaatataccacagctttaactttcctgatatcatttcttttattgcgctacatactaaaatcagtagttaaaattatggactttatagtttacaggtttttgtttgtaattctaattttgtcgccatgtattaaagctcaaaactacggcattaatcttccaattactggttcaatggacactgcgtatgcaaactcaactcaaccggagacatttctgacttccactctatgcctttactatccaacagaagcagctactgagataaaggataactcgtggaaagacacgttatcgcaactattcttaacgaaaggatggccaatagggtcagtctattttaaagaatacaccgacatagcagcgttctcaatcgatccacaactatactgtgattacaacgtagtgctgatgaaatatgacgcttcattacaaatggatatgtcggaacttgcagacttgatactgaatgaatggctttgtaatccaatggacatcacgctatactactaccagcaaacagacgaagcgaacaaatggatctccatgggctcttcatgtaccatcagagtatgtccacttaacactcagacactgggaataggctgtctcactaccgatgttacgaccttcgaagaaattgcgactgcggagaaattagcgataacggacgtcgtagatggcgtgagtcacaagcttaacgttacaaccgcgacttgtacaattcgtaactgtaagaaacttggtccgcgagaaaatgtagcagttatacaagtaggtggctctgacataatagacataactgcagatccaacaactgcaccacaaaccgagagaatgatgcgcattaattggaaaaaatggtggcaagtgttctacaccgtcgttgattatgtaaatcagataatctcaacaatgtccaaacgatctagatcactgaactcagcagctttttattatagagtgtaggtataactgaagttacagctgatgatgtgacc

SEQ ID NO: 1311 - DNA, 2359 bp, Human rotavirus
ggctataaaatggcttcgctcatttatagacagcttctcactaattcatattcagtagatttacatgatgaaatagagcaaattgggtcagaaaaaactcaaaacgtaactgtaaatccaggtccatttgcccaaactagatatgctccagtaaattggggtcatggagagataaatgattcaaccacagtagaaccaattttagatggtccttatcagcctactacatttaaaccacttactgattattggatacttattaactcaaatacaaatggagtggtatacgagagtacgaataatagtgacttttggactgcagtagttgctattgaaccgcacgttatccaagtagatagacaatatactgtatttggtgaaaataaacaatttaatgtaagaaatgattcagataaatggaagtttttagaaatgtttagaggcagtagtcaaaatgaattttataatagacgtacactaacttctgatactaaactcgtaggaatattaaaatatggtggaaggatatggacatttcatggtgaaacaccgagagctactactgatagttcaaatactgcaaatttaaacgatatatcaattataatacattcagaattttatattatcccaaggtcccaagaatctaagtgtaatgaatatattaacaatggtttgccaccaattcaaaatactagaaatgtagtaccattatcattatcatctagatccatacagtataaaagagcacaagttaatgaagatattacaatttcaaaaacctcattatggaaagaaatgcaatgtaatagggatattataattagatttaaatttggtaatagtattgtaaaactggggggactaggttataaatggtccgaaatatcatataaagcagcaaattatcaatataattatctacgtgatggcgaacaagtaactgcacatactacttgctcagtaaatggagtaaataattttagctacaacggaggatctttacctactgattttagtgtctcaaggtatgaagttattaaagaaaattcttatgtatatgtagattattgggatgattcaaaagcatttagaaatatggtatatgtcagatcattagcagctaatttgaactcagtgaaatgtacaggtggaagttatgactttagtatacctgtaggtgcatggccagtcatgaatggtggcgctgtttcgttgcattttgctggagttacattatctacgcaattcacagatttcgtatcattgaattcactacgatttagatttagtttgacagtggatgagccatctttttcaatattgagaacacgtacggtgaatttgtacggattaccagctgcaaatccaaataatggaaatgaatactatgaaatatcaggaaggttttcgctcatttctttagttccaactaatgatgattatcagactccaattatgaattcagtaacagtaagacaagatttagaacgtcaacttactgatttacgagaggaatttaattcattatcacaagaaatagctatgtcacaattaattgatttagcgttattacctttagatatgttttctatgttttcggaattaaaaagtacaattgatttgactaaatcaatggcaactagtgtaatgaaaaaatttagaaaatcaaaattagctacatcaatttcagaaatgactcattcattgtcagacgcagcatcatcagcatcaagaagcgtttctatcagatcgaatatatccacaatttcgaattggactaatgtttcaaatgatgtatcaaatgtgactaattcgttgagtgatatttcaacacaaacgtctacaatcagtaagaaccttagattaaaagaaatgattactcaaactgaaggaatgagttttgatgatatttcagcggcagtattaaaaacaaaaatagatatgtctactcaaattggaaagaatactttacccgatatagtcacagaggcatctgagaaatttattccaaaacgatcgtatcgaatattgaaagatgatgaagtaatggaaattaatactgaagggaaagtctttgcatataaaatcgacacacttaatgaagtgccatttgatgtaaataaatttgctgaacttgtaacaaattctccagttatatcagcaataatcgattttaaaacattaaaaaatttgaatgataattatggaattactcgaatagaagcattaaatttaattaaatcgaatccaaatgtattacgtaatttcattaaccaaaataatccaattataaggaatagaattgaacagctaattctacaatgtaaattgtgagaacgctattgaggatgtgacc

SEQ ID NO: 1312 - DNA, 1062 bp, Murine rotavirus
ggctttaaaagagagaatttccgtctggctagcggatagctccttttaatgtatggtattgaatataccacagttctattttatttgatatcgttcgttcttgtgagttatattctgaaaaccataataaagataatggactatattatttatagaatagcatttgtaattgtagtattatcagtattatcgaatgcacaaaattatggaataaatttgccaattactggatctatggatacagcatatgctaactcaacacaagacaataattttttagtttcaactttatgtctatattatccatcagaagctccaactcaaattagtgacactgaatggaaagatacactatctcagctgtttttaaccaaaggatggccgacaggttcagtttattttaatgaatattcaaacgttttagaattttccatcgacccaaagctatactgtgattataatgttgtgctaattagattcgtttctggtgaggagttggacatatctgaattagctgatctaatactgaatgagtggttatgtaatccaatggatataacattatattattaccaacaaactggagaggcaaacaaatggatatcaatgggatcatcatgtaccgttaaagtgtgtccattaaatactcagacattaggaattggatgtcaaacgacaaatacagctacttttgaaacagttgctgatagcgaaaaattggcaataattgatgttgtctacatcgtaaatcataaattaaatatcacatctactacatgtacaatacggaattgtaataaactaggaccgagagaaaatgtggctataatacaggttggcggttctaatatattagatataacagctgatcccacaacttctccacaaacagaacgaatgatgcgcgtaaactggaaaaaatggtggcaagtattctacactgtagttgattacattaatcagatagtacaagtaatgtccaaaagatcaagatcgttagattcgtcagctttctattatagagtgtagatatatcctaaaatagaactgtttgatgtgacc

SEQ ID NO: 1313 - DNA, 2382 bp, SARS coronavirus
gctagcgccgccaccatggagaccgacaccctgctgctctgggtgctgctgctctgggtgcccggcagcaccggcgacgccgccagcgacctggaccgctgcaccaccttcgacgacgtgcaggcccccaactacacccagcacaccagcagcatgcgcggcgtgtactaccccgacgagatcttccgcagcgacaccctgtacctgacccaggacctgttcctgcccttctactccaacgtgaccggcttccacaccatcaaccacaccttcgacaaccccgtgatccccttcaaggacggcatctacttcgccgccaccgagaagagcaacgtggtgcgcggctgggtgttcggcagcaccatgaacaacaagagccagagcgtgatcatcatcaacaacagcaccaacgtggtgatccgcgcctgcaacttcgagctgtgcgacaaccccttcttcgccgtgagcaagcccatgggcacccagacccacaccatgatcttcgacaacgccttcaactgcaccttcgagtacatcagcgacgccttcagcctggacgtgagcgagaagagcggcaacttcaagcacctgcgcgagttcgtgttcaagaacaaggacggcttcctgtacgtgtacaagggctaccagcccatcgacgtggtgcgcgacctgcccagcggcttcaacaccctgaagcccatcttcaagctgcccctgggcatcaacatcaccaacttccgcgccatcctgaccgccttcagccccgcccaggacacctggggcaccagcgccgccgcctacttcgtgggctacctgaagcccaccaccttcatgctgaagtacgacgagaacggcaccatcaccgacgccgtggactgcagccagaaccccctggccgagctgaagtgcagcgtgaagagcttcgagatcgacaagggcatctaccagaccagcaacttccgcgtggtgcccagcggcgacgtggtgcgcttccccaacatcaccaacctgtgccccttcggcgaggtgttcaacgccaccaagttccccagcgtgtacgcctgggagcgcaagaagatcagcaactgcgtggccgactacagcgtgctgtacaacagcaccttcttcagcaccttcaagtgctacggcgtgagcgccaccaagctgaacgacctgtgcttcagcaacgtgtacgccgacagcttcgtggtgaagggcgacgacgtgcgccagatcgcccccggccagaccggcgtgatcgccgactacaactacaagctgcccgacgacttcatgggctgcgtgctggcctggaacacccgcaacatcgacgccaccagcaccggcaactacaactacaagtaccgctacctgcgccacggcaagctgcgccccttcgagcgcgacatcagcaacgtgcccttcagccccgacggcaagccctgcaccccccccgccctgaactgctactggcccctgaacgactatggcttctacaccaccaccggcatcggctaccagccctaccgcgtggtggtgctgagcttcgagctgctgaacgcccccgccaccgtgtgcggccccaagctgagcaccgacctgatcaagaaccagtgcgtgaacttcaacttcaacggcctgaccggcaccggcgtgctgacccccagcagcaagcgcttccagcccttccagcagttcggccgcgacgtgagcgacttcaccgacagcgtgcgcgaccccaagaccagcgagatcctggacatcagcccctgcagcttcggcggcgtgagcgtgatcacccccggcaccaacgccagcagcgaggtggccgtgctgtaccaggacgtgaactgcaccgacgtgagcaccgccatccacgccgaccagctgacccccgcctggcgcatctacagcaccggcaacaacgtgttccagacccaggccggctgcctgatcggcgccgagcacgtggacaccagctacgagtgcgacatccccatcggcgccggcatctgcgccagctaccacaccgtgagcctgctgcgcagcaccagccagaagagcatcgtggcctacaccatgagcctgggcgccagcggcggcgggggcagcggcggcggcggggagctgtaccactaccaggagtgcgtgcgcggcaccaccgtgctgctgaaggagccctgccccagcggcacctacgagggcaacagccccttccaccccctggccgacaacaagttcgccctgacctgcaccagcacccacttcgccttcgcctgcgccgacggcacccgccacacctaccagctgcgcgcccgcagcgtgagccccaagctgttcatccgccaggaggaggtgcagcaggagctgtactgagaattc

SEQ ID NO: 1314 - protein, 784 aa, SARS coronavirus
METDTLLLWVLLLWVPGSTGDAASDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTTDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTDVSTAIHADQLTPAWRYSTGNNVFQTQAGCLIGAEHVDTSYECDIPIGAGICASYHTVSLLRSTSQKSIVAYTMSLGASGGGGSGGGGELYHYQECVRGTTVLLKEPCPSGTYEGNSPFHPLADNKFALTCTSTHFAFACADGTRHTYQLRARSVSPKLFIRQEEVQQELY

SEQ ID NO: 1315 - DNA, 1295 bp, SARS coronavirus
tctagagccgccaccatggccagcgacaacggcccccagagcaaccagcgcagcgccccccgcatcaccttcggcggccccaccgacagcaccgacaacaaccagaatggcggccggaacggcgcccgccctaagcagcgccgcccccagggcctgcccaacaacaccgccagctggttcaccgccctgacccagcacggcaaggaggagctgcgcttcccccgcggccagggcgtgcccatcaacaccaacagcggccccgacgatcagatcggctactatcgccgcgccaccaggcgcgtgcgcggcggcgacggcaagatgaaggagctgagcccccgctggtacttctactacctgggcaccggccccgaggccagcctgccctacggcgccaacaaggagggcatcgtgtgggtggccaccgagggcgccctgaacacccccaaggaccacatcggcacccgcaaccccaacaacaatgccgccaccgtgctgcagctgccccagggcaccaccctgcccaagggcttctacgccgagggcagccgcggcggcagccaggccagcagccgctccagcagccgcagccgcggcaacagccgcaacagcacccccggcagcagccgcggcaacagccctgcccgcatggccagcggcggcggggagaccgccctggccctgctgctcctggaccgcctgaaccagctggagagcaaggtgtccggcaagggccagcagcagcagggccagaccgtgaccaagaagagcgccgccgaggccagcaagaagccccgccagaagcgcaccgccaccaagcagtacaacgtgacccaggccttcggccgcaggggccccgagcagacccagggcaacttcggcgaccaggacctgatccgccagggcaccgactacaagcactggccccagatcgcccagttcgcccccagcgccagcgccttcttcggcatgagccgcatcggcatggaggtgacccccagcggcacctggctgacctaccacggcgccatcaagctggacgataaggacccccagttcaaggacaacgtgatcctgctgaacaagcacatcgacgcctacaagaccttcccccccaccgagcccaagaaggacaagaaaaagaagaccgacgaggcccagcccctgcctcagcgccagaagaagcagcccaccgtgaccctgctgcccgccgccgacatggacgacttcagccgccagctgcagaacagcatgagcggcgccagcgccgacagcacccaggcctgagcggccgc

SEQ ID NO: 1316 - protein, 421 aa, SARS coronavirus
MSDNGPQSNQRSAPIDTFGGPTDSTDNNQNGGRNGARPKQRRPQGLPNNTASWFTALTQHGKEELRFPRGQGVPINTNSGPDDQIGYYRRATRRVRGGDGKMKELSPRWYFYYLGTGPEASLPYGANKEGIVWVATEGALNTPKDHIGTRNPNNNAATVLQLPQGTTLPKGFYAEGSRGGSQASSRSSSRSRGNSRNSTPGSSRGNSPARMASGGGETALALLLLDRLNQLESKVSGKGQQQQGQTVTKKSAAEASKKPRQKRTATKQYNVTQAFGRRGPEQTQGNFGDQDLIRQGTDYKHWPQIAQFAPSASAFFGMSIDGMEVTPSGTWLTYHGAKLDDKDPQFKDNVILLNKHIDAYKTFPPTEPKKDKKKKTDEAQPLPQRQKKQPTVTLLPAADMDDFSRQLQNSMSGASADSTQA

SEQ ID NO: 1317 - DNA, 2743 bp, Human HBV
ggggggctttttcacctctgcctaatcatctcttgttcatgtcctactgttcaagcctccaagctgtgccttgggtggctttagggcatggacattgacccttataaagaatttggagctactgtggagttactctcgtttttgccttctgacttctttccttccgtacgagatcttctagataccgccgcagctctgtatcgggatgccttagagtctcctgagcattgttcacctcaccatactgcactcaggcaagcaattctttgctggggagacttaatgactctagctacctgggtgggtactaatttagaagatccagcatctagggacctagtagtcagttatgtcaacactaatgtgggcctaaagttcagacaattattgtggtttcacatttcttgtctcacttttggaagagaaacggttctagagtatttggtgtcttttggagtgtggattcgcactcctccagcttatagaccaccaaatgcccctatcctatcaacgcttccggagactactgttgttagacgacgaggcaggtcccctagaagaagaactccctcgcctcgcagacgaagatctcaatcgccgcgtcgcagaagatctcaatctcgggaatctcaatgttagtatcccttggactcataaggtgggaaattttactgggctttattcttctactgtacctgtctttaaccctcattggaaaccgccctcttttcctaatatacatttacaccaagatattatcaaaaaatgtgaacagtttgtagggccgctcacagtcaatgagaaaagaaggttgaaattgatcatgcctgctaggttttatcctaattttaccaaatatttgcccttggataagggtattaaaccttattatccagaacatctagttaatcattacttccaaactagacactatttacacactctatggaaggcgggtgttttatataagagagtatcaacacatagcgcctcattttgtgggtcaccatattcttgggaacaagagctacagcatggggcagaatctttccaccagcaatcctctgggattctttcccgaccaccagttggatccagccttcagagcaaacaccaacaatccagattgggacttcaatcccaacaaggacacctggccagacgccaacaaggtaggagctggagcattcgggctagggttcaccccaccgcacggaggccttttggggtggagccctcaggctcagggcataatgcaaaccttgccagcaaatccgcctcctgcctctaccaatcgccagtcaggacggcagcctaccccgctgtctccacctctgagaaccactcatcctcaggccatgcactggaactccacaaccttccaccaaactctgcaagatcccagagtgagaggcctgtatttccctgctggtggctccagttcagggacagtaaaccctgttccgactactacctctcccatatcgtcaatcttctcgaggattggggaccctgcgctgaacatggagaacatcacatcaggattcctaggacccctgctcgtgttacaggcggggtttttcttgttgacaagaatcctcacaataccgcagagtctagactcgtggtggacttctctcaattttctagggggaactaccgtgtgtcttggccaaaattcgcagtccccaatctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcatcaaccaccagcacgggatcctgcagaacctgcacgactcctgctcaaggaatctctatgtatccctcctgttgctgtacaaaaccttcggatggaaactgcacctgtattcccatcccatcatcctgggctttcggaaaattcctatgggagtgggcctcagcccgtttctcttggctcagtttactagtgccatttgttcagtggttcgtagggctttcccccattgtttggctttcagttatatggatgatgtggtattgggggccaagtctgtacagcatcttgagtccctttttaccgctgttaccaattttcttttgtctttgggcatacatttaaaccctaacaaaacaaaaagatggggttattctctaaatttcatgggctatgtcattggatgttggggatcattgccacaagatcacatcatacacaaaatcaaagaatgttttagaaaactccctgttcacaggcctattgattggaaagtgtgtcaacgaattgtgggtcttctgggttttgctgcccctttcacacaatgtggttatcctgctttaatgcccttgtatgcatgtattcaatctaagcaggctttcactttttcgccaacttacaaggcctttctgtgtaaacaatacctgaacctttaccccgttgccgagcaacggccaggtctgtgccaagtgtttgctgatgcaacccccactggctggggcttggtcatgggccatcagcgcatgcgtggaacctttctggctcctctgccgatccatactgcggaactcctagccgcttgttttgctcgcagcaggtctggagcaaacattctcggaactgacaactctgttgtcctctcccgcaaatatacatcgtttcca

SEQ ID NO: 1318 - DNA, 1485 bp, Human HBV
atgggagccagagccagcatcctgagaggaggcaaactggacaagtgggagaagattagactgcggcctggaggcaagaaacggtacatgatcaagcacctggtgtgggccagcagagagctggagcggttcgcactgaatcctggcctcctggagaccagcgaaggatgcaaacagatcatgaagcagctccaaccagctctgcagaccggcactgaggaactgagaagcctgtacaacaccgtggccaccctgtactgcgtgcacgagggcgtggaagtgcgggacaccaaggaggccctggaccggatcgaggaagagcagaacaagatccagcaaaagatccagcagaagacccaacaggccgctgatggaaaggtgagccagaactaccccatcgtccagaacctccagggccagatggtgcaccagaagctgagccctcggacactgaacgcctgggtcaaggtgatcgaagagaaggccttcagccctgaagtgatccccatgttcacagctctgagcgaaggcgccactcctcaggacctgaacaccatgctgaacaccgtgggaggccaccaagctgcaatgcagatgctgaaggacaccatcaacgaggaagctgccgagtgggacagactgcatccagtccacgccggacccatcgctcctggccagatgcgggaacctagaggaagcgatatcgctggcactacctccaccctgcaagagcagatcgcttggatgaccagcaacccccctatccccgtcggcgacatctacaagcggtggatcatcctgggcctgaacaagatcgtgagaatgtacagccccgtgagcatcctggacatcaagcaaggacctaaggagcccttcagagactacgtcgaccggttctttaagactctgagagccgagcaggcaacccaggaggtgaagaactggatgaccgacacactgctggtccagaacgccaaccccgactgcaagaccatcctgaaggctctgggacccggcgccacactggaagagatgatgacagcatgccagggcgtcggaggaccaagccacaaagcaagagtgctcgccgaggccatgagccagaccaacagcgtgaatatcctgatgcagaagagcaacttcaaaggcaacaagcggatggtcaagtgcttcaactgtggcaaggaaggacacatcgcacggaactgcagagctccacggaagaaaggctgctggaagtgcggcaaggaaggacaccagatgaaggactgcacagagcggcaagcaaacttcctcggaaagatctggccaagccacaagggaagacccggcaatttcctgcagaacagacctgagcccaccgccccacctgctgagagcttccggttcgaagagaccacacccgcccccaagcaggagagcaaggacagagaagcactgaccagcctgaagagcctgttcggcagcgatcccctgagccagtga

SEQ ID NO: 1319 - DNA, 1422 bp, Human HBV
ttgtgggtcacagtctattatggggtacctgtgtggaaagaagcaaccaccactctattttgtgcatcagatgctaaagcatatgatacagaggtacataatgtttgggccacacatgcctgtgtacccacagaccccaacccacaagaagtagaattggaaaatgtgacagaaaattttaacatgtggaaaaataacatggtagaacagatgcatgaggatataatcagtttatgggatcaaagcctaaagccatgtgtaaaattaactccactctgtgttactttaaattgcactgatttgaggaatgctactaatgggaatgacactaataccactagtagtagcagggaaatgatggggggaggagaaatgaaaaattgctctttcaaaatcaccacaaacataagaggtaaggtgcagaaagaatatgcacttttttatgaacttgatatagtaccaatagataataatagtaataatagatataggttgataagttgtaacacctcagtcattacacaggcctgtccaaagatatcctttgagccaattcccatacattattgtgccccggctggttttgcgattctaaagtgtaaagataagaagttcaatggaaaaggaccatgttcaaatgtcagcacagtacaatgtacacatgggattaggccagtagtatcaactcaactgctgttaaatggcagtctagcagaagaagaggtagtaattagatccgaaaatttcgcggacaatgctaaaaccataatagtacagctgaatgaatctgtagaaattaattgtacaagacccaacaacaatacaagaaaaagtatacatataggaccaggcagagcattatatacaacaggagaaataataggagatataagacaagcacattgtaaccttagtagagcaaaatggaatgacactttaaataagatagttataaaattaagagaacaatttgggaataaaacaatagtctttaagcattcctcaggaggggacccagaaattgtgacgcacagttttaattgtggaggggaatttttctactgtaattcaacacaactgtttaatagtacttggaatgttactgaagagtcaaataacactgtagaaaataacacaatcacactcccatgcagaataaaacaaattataaacatgtggcagaaagtaggaagagcaatgtatgcccctcccatcagaggacaaattagatgttcatcaaatattacagggctgctattaacaagagatggtggtccagaggcaaacaagaccgaggtcttcagacctggaggaggagatatgagggacaattggagaagtgaattatataaatataaagtagtaaaaattgaaccattaggagtagcacccaccaaggcaaagagaagagtggtggagtaa

SEQ ID NO: 1320 - DNA, 1422 bp, Human HBV
ctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggcaacgacaccaacaccactagtagcagccgcggcatggtgggcggcggcgagatgaagaactgcagcttcaacatcaccaccaacatccgcggcaaggtgcagaaggagtacgccctgttctacaagctggacatcgcccccatcgacaacaacagcaacaaccgctaccgcctgatcagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggcagcctggccgaggaggaggtggtgatccgcagcgccaacttcgccgacaacgccaaggtgatcatcgtgcagctgaacgagagcgtggagatcaactgcacccgccccaacaacaacacccgcaagtccatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaattgcggcggcgagttcttctactgcaacagcacccagctgttcaacagcacctggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagttcgaacatcaccggcctgctgctgacccgcgacggcggccccgaggacaacaagaccgaggtgttccgccccggcggcggcgacatgcgcgacaactggcgcagcgagctgtacaagtacaaggtggtgaagatcgagcccctgggcgtggcccccaccaaggccaagcgccgcgtggtggagtaa

SEQ ID NO: 1321 - DNA, 1421 bp, Human HBV
ttgtgggtcacagtctattatggggtacctgtgtggaaagaagcaaacaccactctattttgtgcatcagatgctaaagcatatgatacagaggtacataatgtttgggccacacatgcctgtgtacccacagaccccgatccacaagaagtagaattggaaaatgtgacagaaaattttaacatgtggaaaaataacatggtagaacagatgcatgaggatataattagtttatgggatcaaagcctaaagccatgtgtaaaattaaccccactctgtgttactctaaattgcaccaatctgaggaatgatactaataccacgaggaatgctactaataccacgagtagtgagacaatgatggaggagggagaaataaaaaattgctctttcaatatcaccacaagcataagagataaggtgcaaaaagaatttgcacttttttataaacttgatgtagtaccaatagaaaatgatactactagctataggttgataagttgtaatacctcagtccttacacaggcctgcccaaaggtatcctttgagccaattcccatacatttttgtgccccggctggttttgcaattctaaagtgtaaagataagaagttcaatggaacaggaccatgtacaaatgtcagcacagtacaatgcacacatggaattaagccagtagtatcaactcaactgctgttaaatggcagtctagcagaagaagaggtagtaattaggtccgccaatctctcggacaatgctaaaaccataatagtacagctgaatgaatctgtacaaatgaattgtacgagacccaacaacaatacaagaaaaagtatacatataggaccaggcagagcattttatacaacaggagaaataataggagatataagacaagcacattgtaaccttagtagaacaaaatggaatgaaactttaaaaaggatagttataaaattaagagagcaatatgagaataaaacatagtctttaatcaatcctcaggaggggacccagaaattgtaatgctcagctttaattgtggaggggaatttttctactgtaattcaacaaaactgtttaatagtacttggaatggtactgagtcaaataacacaggagatgacccaatcgtactcccatgcagaataaaacaagttataaacatgtggcaagaagtaggaaaagcaatgtatgcccctcccatcagaggacaaattagatgctcatcaaatattacaggactgctattaacaagagatggtggtaacagtaacgagaccaataccaccgagatcttcagacctgggggaggaaatatgaaggacaattggagaagtgaattatataaatataaagtagtaagaattgaaccattaggaatagcacccaccagggcaaagagaagagtggtggagtaa

SEQ ID NO: 1322 - DNA, 1421 bp, Human HBV
ctgtgggtgaccgtctactatggggtgcctgtgtggaaggaggccaacaccactctgttctgcgcttctgacgctaaggcctacgataccgaggtgcacaatgtgtgggccacccacgcctgtgtgcccaccgaccccgaccctcaggaggtggagctggagaacgtgaccgaaaacttcaacatgtggaagaataacatggtggagcagatgcatgaggatatcattagcctgtgggaccagagcctaaagccctgcgtgaagctgacccccctgtgtgtgactctgaactgcaccaacctgaggaatgatactaacaccaccaggaacgccactaatacgaccagcagcgagaccatgatggaggagggcgagatcaagaactgctctttcaacatcaccacgagcatcagagacaaggtgcagaaggagtttgcccttttctataaacttgatgtggtgcctatcgagaatgacactactagctacaggctgatcagctgcaacaccagcgtcctgacacaggcctgccccaaggtgtccttcgagccaattcccatccacttttgtgccccggctggtttcgccattctaaagtgcaaggataagaagttcaacggcaccggtccttgtaccaatgtcagcaccgtacaatgcaccacggcattaagcccgtggtgagcactcagctgctgctgaacggcagcctggccgaggaagaggtggtgattcgctccgccaacctctctgacaatgctaagaccataatcgtgcagctgaacgagtctgtgcagatgaactgcacgaggcccaacaacaataccaggaagagtatccatatcggtcccggcagggcattctataccaccggcgagatcatcggcgacatcaggcaggcccactgtaaccttagcaggacaaagtggaacgagactctgaagaggatcgtgatcaagctgagggagcagtacgagaacaagaccatcgtctttaatcaatccagcggcggggaccctgagattgtgatgctgagcttcaactgcggtggggagttcttctactgtaactcaaccaagctgtttaatagcacttggaacggcactgagtctaacaacaccggtgatgaccccatcgtgctgccatgcaggatcaagcaggtgatcaacatgtggcaggaagtgggcaaggccatgtatgcccctcccatcaggggtcagattaggtgcagcagcaatattaccggcctgctactgacccgcgacggcggtaacagcaacgagaccaacaccaccgagatcttcaggcctgggggcggcaacatgaaggacaattggaggagcgagttatacaaatataaggtggtgaggattgagcctctgggtatcgcccccaccagggccaagaggagggtggtgcagtaa

SEQ ID NO: 1323 - DNA, 1443 bp, Human HBV
ttgtgggtcacagtctattatggggtacctgtgtggaaagaagcaaaaactactctattctgtgcatcagatgctaaatcatatgagaaagaagtgcataatgtctgggctacacatgcctgtgtacccacagaccccaacccacaagaaatagttttgggaaatgtaacagaaaattttaacatgtggaaaaatgacatggtggatcagatgcatgaggatataatcagtttatgggatcaaagcctaaagccatgtgtaaagttgaccccactctgtgtcactttaaattgtacagaggttaatgttaccagaaatgttaataatagcgtggttaataataccacaaatgttaataatagcatgaatggagacatgaaaaattgctctttcaacataaccacagaactaaaagataagaaaaagaatgtgtatgcacttttttataaacttgatatagtatcacttaatgagactgacgactctgagactggcaactctagtaaatattatagattaataaattgtaatacctcagccctaacacaagcctgtccaaaggtctcttttgacccaattcctatacattattgtgctccagctggttatgcgattctaaagtgtaataataagacattcaatgggacaggaccatgccataatgtcagcacagtacaatgtacacatggaattaagccagtggtatcaactcaactactgttaaatggtagcctagcagaagaagggataataattagatctgaaaatctgacaaacaatgtcaaaacaataatagtacatcttaatagatctatagaaattgtgtgtgtaagacccaacaataatacaagacaaagtataagaataggaccaggacaaacattctatgcaacaggagacataataggagacataagacaagcacattgtaacattagtaggactaactggactaagactttacgagaggtaaggaacaaattaagagaacacttccctaataaaaatataacatttaaaccatcctcaggaggggacctagaaattacaacacatagctttaattgtagaggagaatttttctattgcaatacatcgggcctgtttagtataaattatacagaaaataatacagatggtacacccatcacactcccatgcagaataagacaaattataaatatgtggcaggaagtaggacgagcaatgtacgcccctcccattgaaggaaacatagcatgtaaatcagatatcacagggctactattggttcgggatggaggaagcacaaatgatagcacaaataataacacagagatattcagacctgcaggaggagatatgagggacaattggaggagtgaattgtataagtataaagtggtagaaattaagccattgggaatagcacccactgaggcaaaaaggagagtggtggagtaa

SEQ ID NO: 1324 - DNA, 1464 bp, Human HBV
tggggcaacctgtgggtgaccgtgtactacggcgtgcccgtgtggaaggaggccaagaccaccctgttctgcgccagcgacgccaagagctacgagaaggaggtgcacaacgtgtgggccacccacgcctgcgtgcccaccgaccccaacccccaggagatcgtgctgggcaacgtgaccgagaacttcaacatgtggaagaacgacatggtggaccagatgcacgaggacatcatcagcctgtgggaccagagcctgaagccctgcgtgaagctgacccccctgtgcgtgaccctgaactgcaccgaggtgaacgtgacccgcaacgtgaacaacagcgtggtgaacaacaccaccaacgtgaacaacagcatgaacggcgacatgaagaactgcagcttcaacatcaccaccgagctgaaggacaagaagaagaacgtgtacgccctgttctacaagctggacatcgtgagcctgaacgagaccgacgacagcgagaccggcaacagcagcaagtactaccgcctgatcaactgcaacaccagcgccctgacccaggcctgccccaaggtgagcttcgaccccatccccatccactactgcgcccccgccggctacgccatcctgaagtgcaacaacaagaccttcaacggcaccggcccctgccacaacgtgagcaccgtgcagtgcacccacggcatcaagcccgtggtgagcacccagctgctgctgaacggcagcctggccgaggagggcatcatcatccgcagcgagaacctgaccaacaacgtgaagaccatcatcgtgcacctgaaccgcagcatcgagatcgtgtgcgtgcgccccaacaacaacacccgccagagcatccgcatcggccccggccagaccttctacgccaccggcgacatcatcggcgacatccgccaggcccactgcaacatcagccgcaccaactggaccaagaccctgcgcgaggtgcgcaacaagctgcgcgagcacttccccaacaagaacatcaccttcaagcccagcagcggcggcgacctggagatcaccacccacagcttcaactgccgcggcgagttcttctactgcaacaccagcggcctgttcagcatcaactacaccgagaacaacaccgacggcacccccatcaccctgccctgccgcatccgccagatcatcaacatgtggcaggaggtgggccgcgccatgtacgccccccccatcgagggcaacatcgcctgcaagagcgacatcaccggcctgctgctggtgcgcgacggcggcagcaccaacgacagcaccaacaacaacaccgagatcttccgccccgccggcggcgacatgcgcgacaactggcgcagcgagctgtacaagtacaaggtggtggagatcaagcccctgggcatcgcccccaccgaggccaagcgccgcgtggtggagcgcgagaagcgctga

SEQ ID NO: 1325 - DNA, 1407 bp, Human HBV
ttgtgggtcacagtctattatggggtacctgtgtggaaagatgcagataccaccctattttgtgcatcagatgccaaagcacatgagacagaagtgcacaatgtctgggccacacatgcctgtgtacccacagaccccaacccacaagaaatacacctggaaaatgtaacagaaaattttaacatgtggaaaaataaaatggtagagcagatgcaggaggatgtaatcagtttatgggatcaaagtctaaagccatgtgtaaagttaactcctctctgcgttactttgacttgtaccaatgctactctgaattgtaccaatttgaccaatggcaataagacaactaatgtctctaacataataggaaatctaacagatgaagtaagaaactgttcttttcatatgaccacagaactaagagataagaagcagaaggtctatgcacttttttataagcttgatatagtacaaattaatagtagtgagtataggttaataaattgtaatacttcagtcattaagcaggcttgtccaaagatatcctttgatccaattcctatacattattgtactccagctggttatgcgattttaaagtgtaatgataagaatttcaatgggacagggccatgtaaaaatgtcagctcagtacaatgcacacatggaattaagccagtggtatcaactcaattgctgttaaatggcagtctagcagaagaagagataataatcagctctgaaaatctcacaaacaatgccaaaaccataatagtgcaccttaataaatctgtagaaatcagttgtaccagaccctccaccaatacaagaacaagtatacgtataggaccaggacaagtattctatagaacaggagacataacaggagatataagaaaagcatattgtgagattaatgaaacaaaatggaatgaagctttaaaacaggtagctgggaaattaaaagaacactttaataagacaataatctttcaaccaccctcaggaggagatctagaaattacaatgcatcattttaattgtagaggggaatttttctattgcgatacaacacaactgtttaatagaacttggggagaaaatgaaaccagagaggggcgtaatatcacacttccatgcaagataaagcaaattgtaaacatgtggcagggagcagggcaagcaatgtatgctcctcccatcagtggaataattaagtgtgtatcaaatattacaggaatactattgacaagagatggtggtgctaataattcggctagtgagaccttcagacctggaggaggaaatataaaggacaattggagaagtgaattatataaatataaagtagtacaaattgaaccactaggaatagcacccaccagggcaaagagaagagtggtggagtaa

SEQ ID NO: 1326 - DNA, 1407 bp, Human HBV
ctgtgggtgaccgtgtactacggcgtgcccgtgtggaaggacgccgacaccaccctgttctgcgccagcgaggccaaggcccacgagaccgaggtgcacaacgtgtgggccacccacgcctgcgtgcccaccgaccccaacccccaggagatccacctggagaacgtgaccgagaacttcaacatgtggaagaacaagatggtggagcagatgcaggaggacgtgatcagcctgtgggaccagagcctgaagccctgcgtgaagctgacccccctgtgcgtgaccctgacctgcaccaacgccaccctgaactgcaccaacctgaccaacggcaacaagaccaccaacgtgagcaacatcatcggcaacctgaccgacgaggtgcgcaactgcagcttccacatgaccaccgagctgcgcgacaagaagcagaaggtgtacgccctgttctacaagctggacatcgtgcagatcaacagcagcgagtaccgcctgatcaactgcaacaccagcgtgatcaagcaggcctgccccaagatcagcttcgaccccatccccatccactactgcacccctgctggctacgccatcctgaagtgcaacgacaagaacttcaacggcaccggaccctgcaagaacgtgagcagcgtgcagtgcacccacggcatcaagcccgtggtgagcacccagctgctgctgaacggcagcctggccgaggaggagatcatcatcagcagcgagaacctgaccaacaacgccaagaccatcatcgtgcacctgaacaagagcgtggagatcagctgcactcgccccagcaccaacacccgcaccagcatccgcatcggacctggccaggtgttctaccgcaccggcgacatcaccggcgacatccgcaaggcctactgcgagatcaacgagaccaagtggaacgaggccctgaagcaggtggccggcaagctgaaggagcacttcaacaagaccatcatcttccagcctcccagcggaggcgacctggagatcaccatgcaccacttcaactgcagaggcgagttcttctactgcgacaccacccagctgttcaaccgcacctggggcgagaacgagacccgcgagggcaggaacatcaccctgccctgcaagatcaagcagatcgtgaacatgtggcagggagctggccaggccatgtacgccccacccatcagcggcatcatcaagtgcgtgagcaacatcaccggcatcctgctgacccgcgacggcggtgccaacaacagcgccagcgagaccttcaggccaggcggtggcaacatcaaggacaactggcgcagcgagctgtacaagtacaaggtggtgcagatcgagcccctgggcatcgcccccactcgcgccaagcgccgcgtggtggagtaa

SEQ ID NO: 1327 - DNA, 1410 bp, Human HBV
ttgtgggtcacagtctattatggggtacctgtgtggaaagatgcagagactaccttattttgtgcatcagatgcgaaagcatatgatacagaagtgcataatgtctgggctacgcatgcctgtgtacctacagaccccaacccacaagaaatatatatggaaaatgtgacagaagagtttaacatgtggaaaaataacatggtagagcagatgcatacagatataatcagtctatgggaccaaagcctaaaaccatgtgtacagttaacccctctctgcgttactttagattgtagctataacatcagcaataatatcaccaatagcatcaccaatagctcagttaacatgagagaagaaataaaaaactgctctttcaatatgaccacagaattaagggataagaatcggaaggtatattcacttttttataaacttgatgtagtacaaattaataatggtaataacagtagtaatctgtatagattaataaattgtaatacctcagcccttacacaggcttgtccaaaggtaacctttgagccaattcccatacgttattgtgccccagctggttatgcgattctaaaatgtaatgataaggagttcaatggaacagggctatgcaaaaatgtcagcacagtgcaatgcacacatggaatcaggccagtagtatcaactcaactgctgttaaatggcagtttagcagaaggaaaggtaatgattagatctgaaaatatcacaaacaatgtcaaaaacataatagtacaacttaacgagactgtaacaattaattgtaccagacctaacaacaatacaagaaaaagtgtacgtataggaccaggacaaacattctatgcaacaggtgatataataggggatataagacaagcacattgtaatgtcagtgggtcacaatggaatagagctttacaccaggtagttggacaattaagagaatactggaacacaacaataatctttaaaaactcctcaggaggggatttagaaattacaacacatagttttaattgtggaggagaatttttctattgtaatacatcaggcctgtttaatagtaattggacacataatgacactgccagcatgaaaccaaatgacactataacactcccatgcagaataaagcaaattataaatatgtggcagagagtaggacaagcaatatatgcccctcccattcaaggagtaataaggtgtgaatcaaacattacaggactaatattaacaagagatggtgggggtaacatcaatgaaagtcaaatcttcagacctggaggaggagatatgagggacaattggagaagtgaattatataagtataaggtagtaagaattgaaccactaggagtagcacccaccaaggcaaagagaagagtggtggagtaa

SEQ ID NO: 1328 - DNA, 1410 bp, Human HBV
ctgtgggtgaccgtgtactacggcgtgcccgtgtggaaggacgccgagaccaccctgttctgcgccagcgacgccaaggcctacgacaccgaggtgcacaacgtgtgggccacccacgcctgcgtgcccaccgaccccaacccccaggagatctacatggagaacgtgaccgaggagttcaacatgtggaagaacaacatggtggagcagatgcacaccgacatcatcagcctgtgggaccagagcctgaagccctgcgtgcagctgacccccctgtgcgtgaccctggactgcagctacaacatcaccaacaacatcaccaacagcatcaccaacagcagcgtgaacatgcgcgaggagatcaagaactgcagcttcaacatgaccaccgagctgcgcgacaagaaccgcaaggtgtacagcctgttctacaagctggacgtggtgcagatcaacaacggcaacaacagcagcaacctgtaccgcctgatcaactgcaacaccagcgccctgacccaggcctgccccaaggtgaccttcgagcccatccccatccgctactgcgcccccgccggctacgccatcctgaagtgcaacgacaaggagttcaacggcaccggcctgtgcaagaacgtgagcaccgtgcagtgcacccacggcatccgccccgtggtgagcacccagctgctgctgaacggcagcctggccgagggcaaggtgatgatccgcagcgagaacatcaccaacaacgtgaagaacatcatcgtgcagctgaacgagaccgtgaccatcaactgcacccgccccaacaacaacacccgcaagagcgtgcgcatcggccccggccagaccttctacgccaccggcgacatcatcggcgacatccgccaggcccactgcaacgtgagcggcagccagtggaaccgcgccctgcaccaggtggtgggccagctgcgcgagtactggaacaccaccatcatcttcaagaacagcagcggcggcgacctggagatcaccacccacagcttcaactgcggcggcgagttcttctactgcaacaccagcggcctgttcaacagcaactggacccacaacgacaccgccagcatgaagcccaacgacaccatcaccctgccctgccgcatcaagcagatcatcaacatgtggcagcgcgtgggccaggccatctacgcccctcccatccagggcgtgatccgctgcgagagcaacatcaccggcctgatcctgacccgcgacggcggcggcaacatcaacgagagccagatcttccgccccggcggcggcgacatgcgcgacaactggcgcagcgagctgtacaagtacaaggtggtgcgcatcgagcccctgggcgtggcccccaccaaggccaagcgccgcgtggtggagtaa

SEQ ID NO: 1329 - protein, 685 aa, Artificial Sequence; identical to SEQ ID NO: 1199
  Mutant Hepatitis C virus NS3/4A peptid

SEQ ID NO: 1330 - protein, 685 aa, Artificial Sequence; identical to SEQ ID NO: 1200
  Mutant Hepatitis C virus NS3/4A peptide
  VARIANT 27: Xaa is anything but Asn

SEQ ID NO: 1331 - protein, 685 aa, Artifical Sequence; identical to SEQ ID NO: 1201
  Mutant Hepatitis C virus NS3/4A peptide
  VARIANT 28: Xaa is anything but Gln

SEQ ID NO: 1332 - protein, 685 aa, Artificial Sequence; identical to SEQ ID NO: 1202
  Mutant Hepatitis C virus NS3/4A peptide
  VARIANT 29: Xaa is anything but Val

SEQ ID NO: 1333 - protein, 685 aa, Artificial Sequence; identical to SEQ ID NO: 1203
  Mutant Hepatitis C virus NS3/4A peptide
  VARIANT 30: Xaa is anything but Glu

SEQ ID NO: 1334 - protein, 685 aa, Artificial Sequence; identical to SEQ ID NO: 1204
  Mutant Hepatitis C virus NS3/4A peptide
  VARIANT 31: Xaa is anything but Gly

SEQ ID NO: 1335 - protein, 685 aa, Artificial Sequence; identical to SEQ ID NO: 1205
  Mutant Hepatitis C virus NS3/4A peptide
  VARIANT 32: Xaa is anything but Glu

SEQ ID NO: 1336 - protein, 685 aa, Artificial Sequence; identical to SEQ ID NO: 1206
  Mutant Hepatitis C virus NS3/4A peptide
  VARIANT 33: Xaa is anything but Val

SEQ ID NO: 1337 - protein, 685 aa, Artificial Sequence; identical to SEQ ID NO: 1207
  Mutant Hepatitis C virus NS3/4A peptide
  VARIANT 34: Xaa is anything but Gln

SEQ ID NO: 1338 - protein, 685 aa, Artificial Sequence; identical to SEQ ID NO: 1208
  Mutant Hepatitis C virus NS3/4A peptide
  VARIANT 35: Xaa is anything but Ile

SEQ ID NO: 1339 - protein, 685 aa, Artificial Sequence; identical to SEQ ID NO: 1209
  Mutant Hepatitis C virus NS3/4A peptide
  VARIANT 36: Xaa is anything but Val

SEQ ID NO: 1340 - protein, 18 aa, Hepatitis C virus
SADLEVVTSTWVLVGGVL

SEQ ID NO: 1341 - protein, 16 aa, Hepatitis C virus
DEMEECSAHLPYIEQG

SEQ ID NO: 1342 - protein, 20 aa, Hepatitis C virus
CMSADLEVVTSTWVLVGGVL

SEQ ID NO: 1343 - protein, 20 aa, Hepatitis C virus
CMSADLEVVTSTWVLVGGVL

SEQ ID NO: 1344 - protein, 20 aa, Hepatitis C virus
CMSADLEVVTSTWVLVGGVL

SEQ ID NO: 1345 - protein, 20 aa, Hepatitis C virus
CMSADLEVVTSTWVLVGGVL

SEQ ID NO: 1346 - protein, 20 aa, Hepatitis C virus
CMSADLEVVTSTWVLVGGVL

SEQ ID NO: 1347 - protein, 20 aa, Hepatitis C virus
CMQADLEVMTSTWVLAGGVL

SEQ ID NO: 1348 - protein, 20 aa, Hepatitis C virus
CMSADLEVVTSTWVLVGGVL

SEQ ID NO: 1349 - protein, 20 aa, Hepatitis C virus
CMQADLEIMTSSWVLAGGVL

SEQ ID NO: 1350 - protein, 20 aa, Hepatitis C virus
CMSAQLEVVTSTWVLVGGVL

SEQ ID NO: 1351 - protein, 20 aa, Hepatitis C virus
YQEFDEMEECSQHLPYIEQG

SEQ ID NO: 1352 - protein, 20 aa, Hepatitis C virus
YQEFDEMEECSQHLPYIEQG

SEQ ID NO: 1353 - protein, 20 aa, Hepatitis C virus
YREFDEMEECSQHLPYIEQG

SEQ ID NO: 1354 - protein, 20 aa, Hepatitis C virus
YQEFDEMEECASHLPYIEQG

SEQ ID NO: 1355 - protein, 20 aa, Hepatitis C virus
YQEFDEMEECASHLPYIEQG

SEQ ID NO: 1356 - protein, 20 aa, Hepatitis C virus
YEAFDEMEECASRAALIEEG

SEQ ID NO: 1357 - protein, 20 aa, Hepatitis C virus
YQEFDEMEECASHLPYIEQG

SEQ ID NO: 1358 - protein, 20 aa, Hepatitis C virus
YQAFDEMEECASKAALIEEG

SEQ ID NO: 1359 - protein, 20 aa, Hepatitis C virus
YREFDEMEECASHLPYIEQG

SEQ ID NO: 1360 - protein, 20 aa, Hepatitis C virus
WISSECTTPCSGSWLRDIWD

SEQ ID NO: 1361 - protein, 20 aa, Hepatitis C virus
WISSECTTPCSGSWLRDIWD

SEQ ID NO: 1362 - protein, 20 aa, Hepatitis C virus
WISSECTTPCSGSWLRDIWD

SEQ ID NO: 1363 - protein, 20 aa, Hepatitis C virus
WINEDCSTPCSGSWLKDVWD

SEQ ID NO: 1364 - protein, 20 aa, Hepatitis C virus
WINEDCSTPCSGSWLRDVWD

SEQ ID NO: 1365 - protein, 20 aa, Hepatitis C virus
WITEDCPIPCSGSWLRDVWD

SEQ ID NO: 1366 - protein, 20 aa, Hepatitis C virus
WINEDCSTPCSGSWLRDVWD

SEQ ID NO: 1367 - protein, 20 aa, Hepatitis C virus
WITEDCPVPCSGSWLQDIWD

SEQ ID NO: 1368 - protein, 20 aa, Hepatitis C virus
WINEDCSTPCSGSWLKDVWD

SEQ ID NO: 1369 - protein, 20 aa, Hepatitis C virus
WINEDCSTPCSGSWLRDVWD

SEQ ID NO: 1370 - protein, 20 aa, Hepatitis C virus
GADTEDVVCCSMSYTWTGAL

SEQ ID NO: 1371 - protein, 20 aa, Hepatitis C virus
GADTEDVVCCSMSYSWTGAL

SEQ ID NO: 1372 - protein, 20 aa, Hepatitis C virus
EANAEDVVCCSMSYSWTGAL

SEQ ID NO: 1373 - protein, 20 aa, Hepatitis C virus
GEAGEDVVCCSMSYTWTGAL

SEQ ID NO: 1374 - protein, 20 aa, Hepatitis C virus
EEASEDVVCCSMSYTWTGAL

SEQ ID NO: 1375 - protein, 20 aa, Hepatitis C virus
SEEDDSVVCCSMSYSWTGAL

SEQ ID NO: 1376 - protein, 20 aa, Hepatitis C virus
EEDGEGVICCSMSYTWTGAL

SEQ ID NO: 1377 - protein, 20 aa, Hepatitis C virus
SDQEDSVICCSMSYSWTGAL

SEQ ID NO: 1378 - protein, 20 aa, Hepatitis C virus
GEASDDIVCCSMSYTWTGAL

SEQ ID NO: 1379 - protein, 21 aa, E. Coli
DEVFATYYFNKNMSTYVDYII

SEQ ID NO: 1380 - DNA, 2588 bp, Artificial Sequence
  NS3/4A-Betv1 Fusion Gene
gaattcgcaccatggcgcctatcacggcctatgcccagcagacaaggggccttttgggatgcataatcaccagcttgaccggccgggacaaaaaccaggtggagggtgaggttcagatcgtgtcaactgctgcccagactttcttggcaacctgcattaacggggtgtgttggactgtctaccatggagccggaacaaggaccattgcgtcacctaagggtcctgttatccagatgtacaccaatgtggaccaagacctcgtaggctggcccgctccccaaggtgcccgctcattaacaccatgcacttgcggctcctcggacctttacctggtcacgaggcacgccgatgtcattcctgtgcgccgacggggtgatggcaggggcagcctgctttcgccccggcctatctcttacttgaaaggctcctcgggaggccctctgctgtgccccgcaggacatgccgtaggcatattcagagccgcggtatgcacccgtggagtggctaaggcggtggacttcatccccgtagagagcttagagacaaccatgaggtccccggtgttctcagacaactcctccccaccagcagtgccccagagctaccaagtggcccacctgcatgctcccaccggcagcggtaagagcaccaaggtcccggccgcatacgcagctcagggctacaaggtgctggtgctcaacccctccgttgctgcaacaatgggctttggtgcttacatgtccaaggcccatgggattgatcctaacatcaggactggggtgaggacaattactactggcagcccgatcacgtattccacctacggcaagttccttgccgacggcgggtgttcagggggtgcttatgacataataatttgtgacgagtgccactccacggatgcaacatccatcttgggcattggcactgtccttgaccaagcagagaccgcgggggcgagactgactgtgctcgccaccgctacccctccgggctccgtcactgtgccccatcctaacatcgaggaggttgctctgtccactaccggagagatccccttttatggcaaggctattccccttgaagcaattaagggggggagacatctcatcttctgccactcaaagaagaagtgcgacgagctcgccgcaaaactggtcgcgttgggcgtcaatgccgtggcttactaccgcggccttgatgtgtccgtcatcccgaccagtggtgacgttgtcgtcgtggcaactgacgccctcatgaccggctttaccggcgacttcgattcggtgatagactgcaacacgtgtgtcacccagacagtcgacttcagccttgaccctaccttcaccattgagacaatcacgcttccccaggatgctgtctcccgtactcaacgtcggggtaggactggcagagggaagccaggcatctacagatttgtggcaccgggggagcgtccttctggcatgtttgactcgtctgtcctctgcgagtgctatgacgcgggttgtgcttggtatgagcttacgcccgccgagaccacagttaggctacgagcatacatgaacaccccgggacttcccgtgtgccaagaccatcttgaattttgggagggcgtctttacgggtctcacccacatagacgcccacttcctatcccagacaaagcagagtggggaaaaccttccctatctggtagcgtaccaagccaccgtgtgcgctagagctcaagcccctcccccgtcgtgggaccagatgtggaagtgcttgatccgtctcaagcccaccctccatgggccaacacctctgctatatagactgggcgctgtccagaatgaagtcaccctgacgcacccagtcaccaagtatatcatgacatgtatgtcggctgacctggaggtcgtcacgagtacctgggtgctcgttggcggcgttctggctgctttggccgcgtattgcctatccacaggctgcgtggtcatagtaggtaggattgtcttgtccggaaagccggcaatcatacccgacagggaagtcctctaccgggagttcgatgaaatggaagagtgcagccagcacctgccctacatcgagcagggcatgggcgtcttcaattacgaaaccgagacaactagtgtgatcccagctgcacgcctttttaaggccttcattcttgatggagacaaccttgtgccaaaggtggctccccaagctattagtagcgtcgaaaacatcgagggaaatggcggaccgggaaccatcaaaaagatcaactttccggagggcttccctttcaagtacgttaaggacagggttgatgaagttgatcatacaaattttaagtacaactactccgtgatcgagggcggccccgttggagatactctggaaaagatcagcaacgagattaagatcgtggctacacccgatggcgggtgtgtgcttaagatctccaacaaatatcataccaaagggaaccacgaggttaaggctgaacaggtgaaggcatcaaaggagatgggagagaccctcctccgagcggtggagtcttacttgctcgcacacagcgatgcttacaattagtctaga

SEQ ID NO: 1381 - DNA, 2696 bp, Artificial Sequence
  NS3/4A-Betv1 Fusion Gene
gaattcgcaccatggcgcctatcacggcctatgcccagcagacaaggggccttttgggatgcataatcaccagcttgaccggccgggacaaaaaccaggtggagggtgaggttcagatcgtgtcaactgctgcccagactttcttggcaacctgcattaacggggtgtgttggactgtctaccatggagccggaacaaggaccattgcgtcacctaagggtcctgttatccagatgtacaccaatgtggaccaagacctcgtaggctggcccgctccccaaggtgcccgctcattaacaccatgcacttgcggctcctcggacctttacctggtcacgaggcacgccgatgtcattcctgtgcgccgacggggtgatggcaggggcagcctgctttcgccccggcctatctcttacttgaaaggctcctcgggaggccctctgctgtgccccgcaggacatgccgtaggcatattcagagccgcggtatgcacccgtggagtggctaaggcggtggacttcatccccgtagagagcttagagacaaccatgaggtccccggtgttctcagacaactcctccccaccagcagtgccccagagctaccaagtggcccacctgcatgctcccaccggcagcggtaagagcaccaaggtcccggccgcatacgcagctcagggctacaaggtgctggtgctcaacccctccgttgctgcaacaatgggctttggtgcttacatgtccaaggcccatgggattgatcctaacatcaggactggggtgaggacaattactactggcagcccgatcacgtattccacctacggcaagttccttgccgacggcgggtgttcagggggtgcttatgacataataatttgtgacgagtgccactccacggatgcaacatccatcttgggcattggcactgtccttgaccaagcagagaccgcgggggcgagactgactgtgctcgccaccgctacccctccgggctccgtcactgtgccccatcctaacatcgaggaggttgctctgtccactaccggagagatccccttttatggcaaggctattccccttgaagcaattaagggggggagacatctcatcttctgccactcaaagaagaagtgcgacgagctcgccgcaaaactggtcgcgttgggcgtcaatgccgtggcttactaccgcggccttgatgtgtccgtcatcccgaccagtggtgacgttgtcgtcgtggcaactgacgccctcatgaccggctttaccggcgacttcgattcggtgatagactgcaacacgtgtgtcacccagacagtcgacttcagccttgaccctaccttcaccattgagacaatcacgcttccccaggatgctgtctcccgtactcaacgtcggggtaggactggcagagggaagccaggcatctacagatttgtggcaccgggggagcgtccttctggcatgtttgactcgtctgtcctctgcgagtgctatgacgcgggttgtgcttggtatgagcttacgcccgccgagaccacagttaggctacgagcatacatgaacaccccgggacttcccgtgtgccaagaccatcttgaattttgggagggcgtctttacgggtctcacccacatagacgcccacttcctatcccagacaaagcagagtggggaaaaccttccctatctggtagcgtaccaagccaccgtgtgcgctagagctcaagcccctcccccgtcgtgggaccagatgtggaagtgcttgatccgtctcaagcccaccctccatgggccaacacctctgctatatagactgggcgctgtccagaatgaagtcaccctgacgcacccagtcaccaagtatatcatgacatgtatgtcggctgacctggaggtcgtcacgagtacctgggtgctcgttggcggcgttctggctgctttggccgcgtattgcctatccacaggctgcgtggtcatagtaggtaggattgtcttgtccggaaagccggcaatcatacccgacagggaagtcctctaccgggagttcgatgaaatggaagagtgcagccagcacctgccctacatcgagcagggcatgggcgtcttcaattacgaaaccgagacaactagtgtgatcccagctgcacgcctttttaaggccttcattcttgatggagacaaccttgtgccaaaggtggctccccaagctattagtagcgtcgaaaacatcgagggaaatggcggaccgggatcggctgacctggaggtcgtcacgagtacctgggtgctcgttggcggcgttctgaccatcaaaaagatcaactttccggagggcttccctttcaagtacgttaaggacagggttgatgaagttgatcatacaaattttaagtacaactactccgtgatcgagggcggccccgttggagatactctggaaaagatcagcaacgagattaagatcgtgtcggctgacctggaggtcgtcacgagtacctgggtgctcgttggcggcgttctggctacacccgatggcgggtgtgtgcttaagatctccaacaaatatcataccaaagggaaccacgaggttaaggctgaacaggtgaaggcatcaaaggagatgggagagaccctcctccgagcggtggagtcttacttgctcgcacacagcgatgcttacaattagtctaga

SEQ ID NO: 1382 - protein, 869 aa, Artificial Sequence; identical to SEQ ID NO: 1181
  NS3/4A HBcAg Fusion Protein

SEQ ID NO: 1383 - protein, 869 aa, Artificial Sequence; identical to SEQ ID NO: 1183
  NS3/4A-HBcAg Fusion Protein

SEQ ID NO: 1384 - protein, 869 aa, Artificial Sequence; identical to SEQ ID NO: 1185
  NS3/4A-HBcAg Fusion Protein

SEQ ID NO: 1385 - protein, 879 aa, Artificial Sequence; identical to SEQ ID NO: 1187
  NS3/4A-HBcAg Fusion Protein

SEQ ID NO: 1386 - protein, 933 aa, Artificial Sequence; identical to SEQ ID NO: 1189
  NS3/4A-HBcAg Fusion Protein

SEQ ID NO: 1387 - protein, 933 aa, Artificial Sequence; identical to SEQ ID NO: 1191
  NS3/4A-HBcAg Fusion Protein
